(12) United States Patent
Gill et al.

(10) Patent No.: US 8,105,776 B2
(45) Date of Patent: Jan. 31, 2012

(54) BREED-SPECIFIC HAPLOTYPES FOR POLLED PHENOTYPES IN CATTLE

(75) Inventors: Clare A. Gill, Bryan, TX (US); Stewart Bauck, Cumming, GA (US); Brent Woodward, Lawrenceville, GA (US); Nathan Voss, Lawrenceville, GA (US)

(73) Assignees: Merial Limited, Duluth, GA (US); The Texas A&M University System, College Station, TX (US)

( * ) Notice: Subject to any disclaimer, the term of this patent is extended or adjusted under 35 U.S.C. 154(b) by 254 days.

(21) Appl. No.: 12/338,835

(22) Filed: Dec. 18, 2008

(65) Prior Publication Data
US 2009/0228319 A1    Sep. 10, 2009

Related U.S. Application Data

(60) Provisional application No. 61/015,521, filed on Dec. 20, 2007.

(51) Int. Cl.
*C12Q 1/68* (2006.01)
(52) U.S. Cl. ......................................................... 435/6.1
(58) Field of Classification Search .................. None
See application file for complete search history.

(56) References Cited

U.S. PATENT DOCUMENTS

| 7,972,783 | B2 * | 7/2011 | DeNise et al. ............... 435/6.11 |
| 2007/0134701 | A1 | 6/2007 | Denise et al. |

FOREIGN PATENT DOCUMENTS

| WO | WO 2005/052133 A | 6/2005 |
| WO | WO 2005/101230 A | 10/2005 |
| WO | WO 2009/045289 A | 4/2009 |

OTHER PUBLICATIONS

Georges et al., Nature Genetics 4: 206-210 (1993).
Brenneman et al., J. Heredity 87:156-161 (1996).
Drogemuller et al., Mammalian Genome 16: 613-620 (2005).
Database DBSNP [Online] NCBI; Oct. 24, 2007, "Bos Taurus Resequencing" XP002527654 retrieved from NCBI Database accession No. rs41639647, the whole document.

* cited by examiner

*Primary Examiner* — Juliet Switzer
(74) *Attorney, Agent, or Firm* — Judy Jarecki-Black; Chad Kitchen; Merial Limited

(57) ABSTRACT

The presence of horns within commercial cattle populations increases the chances of injuries. The Polled (hornless) condition in cattle has existed since domestication, and it has been selected by breeders because of its economic importance and ease of management. A dominant mutation is believed to cause the polled phenotype. The present invention relates to the identification of breed-specific single nucleotide polymorphisms (SNPs) and their haplotypes, in the bovine genome, in or near gene(s) encoding polypeptides associated with the Polled phenotyped in beef production. The invention further encompasses methods and systems, including network-based processes, to manage the SNP data, haplotype data and other data relating to specific animals and herds of animals, veterinarian care, diagnostic and quality control data and management of livestock which, based on genotyping, have predictable productions quality traits, husbandry conditions, animal welfare, food safety information, audit of existing processes and data from field location.

9 Claims, 21 Drawing Sheets

FIG. 1

A1356048G
[SEQ ID NO. 1]
ACCCACGGACATGTAGAGGCCTTGATATCTCCNNNNNNNNNNNNNNNNNNNNNNNNNNNN
NNNNNNNNNNNNNNNNNNNNTAGAAGCTGTCCTGGGAAAGGGATCTGCCTGGCCAGGAGTGG
TTTGGTGTACAACCTCGGTGCTCACTGAGCGGACTTTGGTTTTCTTGGAAAACTAAAAGACAAGC
CTCTGACTGCTAACCATGTTATCTGTATAACTGGAGATGATTTCAGTGGTATTTCCCTCTT[A/G]A
AAAAAGATAAATTGTGCCACTTGAGTGCAGCTGTCACTGATTGGGTCTATGTGAACAGGATAAAA
GAGTTATGTTCCCCAGCAGCTCTGTGATAAATTGTTGAAGAGCCACAGCAATAAACAAGAAAAGC
TGACCACAGGAATGTCCCAGACAGAAAGGAAAAGGCCAGCAAGGAGGCTCCCTAGGGGGCTGT
CATGGTCTCTCGGGGACCATAGTCAGACTCTCTGCTGTGGTGCAGCCCACACACCA

FIG. 2

A1872077G
[SEQ ID NO. 2]
GGGCTAGCCTGGGAATGTAATAACCCCTTTATAACACTACTCGCATGGGTAAATACATCCAGATT
ACTTATAGATAATTAACAGAAGAATTTTTAGGGCTCAGTCCATTTGGAAGTTTAAGACTGGAAAGT
GAAGACACTCTGTATGATGGGGTTAACATAAAATGCTTTTATGTGTGTTCATACAAAGAACCAAG
GCAATATTTTTCATTAATTTTCCCTGGAGAATAGCTGCTTTACAAAGTTGTGTC[A/G]GCTTCTGC
TCTCAGCAAAGTGAATCACCAAACGGATACATGTATCCTCCCTTTTTTGGATTTCCTCCCGTTTAA
GTCACCAGCAAGCACAGAGGAGAGTTCGCAGTGCTGGACAGTGGGTTTTCATCAGTTATCTATT
CTATAGATAGTATCCATTTTTAAAAATTAAACTGACTCATCATTGGACAAAGAAAATCTTCCTTCAC
AGAAACCCAACTCCACACTAAAATGGGATATAAAGAATTTGTGGC

FIG. 3

T1872200C
[SEQ ID NO. 3]
CTGGAAAGTGAAGACACTCTGTATGATGGGGTTAACATAAAATGCTTTTATGTGTGTTCATACAA
AGAACCAAGGCAATATTTTTCATTAATTTTCCCTGGAGAATAGCTGCTTTACAAAGTTGTGTCAGC
TTCTGCTCTCAGCAAAGTGAATCACCAAACGGATACATGTATCCTCCCTTTTTTGGATTTCCTCCC
GTTTAAGTCACCAGCAAGCACAGAGGAGAGTTCGCAGTGCTGGACAGTGGGTT[T/C]TCATCAG
TTATCTATTCTATAGATAGTATCCATTTTTAAAAATTAAACTGACTCATCATTGGACAAAGAAAATC
TTCCTTCACAGAAACCCAACTCCACACTAAAATGGGATATAAAGAATTTGTGGCAATTATGGTACA
AACACCTAAACCCAGAAGGCAGAAAGTTGGAACGTATTGAATGCATGATACCGTAATGATAAGAA
ATAGTTCTACCATGAAATAACACGTATTTTTCTCTTAGCCTTAAC

FIG. 4

T2101528C
[SEQ ID NO. 4]
CACTAATGTGGAAGTTCATACAGAAAAGAAGGAAGTCAGGAATTAATTTCTAAGCGGATCTGTCT
TACTCCTTTGGATATGAGCGAAGAAACCGATTTGAGCTGGTTTAAGCCCGAAGTGAGTTGGTTGG
GGAGGTAGCCTACGGGTAGAAAGCCATCTTCAGAAGCCAGACCAGGAAAGAAAGCCTCAGGGC
GGGACTAAACTGGAACTTCGCGAGCATGGAGTCTCTCTGTCTGTCTGTCTCTCTGCT[T/C]CTCT
CTCTCCCCTCTACGGCTTTTCTCTGAGCCTGGGCTAGATGGCATACAGTCATCCCCACAACCCAG
GCGATTCTTAAGTTACACTTTTCTGTCCTAACAATTTATAAAGACTACCAATCTGGCAACTTCCTTC
CAAATTCCTACCAGAGAGCTGTTTCTTTGGCTGGACTGGGGTCAGGTAGCCCCCTCCTGTGATCT
GCCTTGGCCAGAGACCATGTGACATGATATGATTATAAACTTGGCTGCC

FIG. 5

T2214142A
[SEQ ID NO. 5]
TGTTTTCCACCGTGTCAGGAATCTGAACTTTGGGGTTCTCTGGGACATAAAAGATGGATGCCAGC
GGGTGAGAACTAACTTCCGTTTCAGTTCAAAATCCATTGCTGGCAGCACCCGTGAGAGGGTCTCT
GCTGTGCTCACATGGGATAGAAAGACCTAGAATGGCAGTTCGGGACCAGCACTCCAGAGCCCTG
ATTCCCAGGACTTCAGTGGACAGAGAACCCCAAACATCGGGAGCCTTTCCAACTCA[T/A]GGGG
GAAGGATGAAACCTAATTTCATTTTACCAGGCAAGTTTTAGCATTTTGCCAGAATTCTTTTCGAGT
TTAAGGCGTGTGAAGACCAGGATAAGTGAACTGTGCTTGAATCAGGTGGCACGTAGGTTTGAAC
GGTGAGGCATCCAGATGGCTTAGAAGCAGTGGTCGCTTGAAGCAGTTACTGAGGACAGGGATA
GTATCCGAGTCACCTCTGTGTCCTCCCAGCCTGAGGTTATGACACCTTGAGTG

FIG. 6

T2220054C
[SEQ ID NO. 6]
TCACAACAGTTATTTGTCCCCAGATGTCAGTAGTCCTGAGATTGAAAAAGTTCCTGGATTCAAAG
CAGAGCAAGTCATGAGATTACAGGTTTTTTCACCTACCAAGTTGGCCTTGACTTTTCAGACCTGAT
ACTCAGCACCAGCAAAGAATCAGGTACTTCCCTGGAGGAAGTGTTATGGCCCCTCTGGAAGACA
GCAGGTCTGGCAGTGTGTATGTCAGAGGTCTTGAAAATGTGTATCAACCTGGAGG[T/C]GGGGG
TTTGGGGAGTCGCCTCAGGATCACCCAGGGAATGGATTTGAAAAAACTCATAAGCCCTCAGAGA
TCCGGGCTGGGGGCTAGGTTGGGAGGAGCTGAGAACTTGTGCACCATTCCAAGAACATAGGTA
GGCACGCAGTGCAGGCTGCTGCTCGTGGGAACAGCCTGATCGTACCACTTGGGGAATGGGTAC
ATGACTTACGGTCACTCCTAGGACAGAGTGATGATCAGCCCTCCAAAATGATGTT

FIG. 7

T2220178A
[SEQ ID NO. 7]
GACCTGATACTCAGCACCAGCAAAGAATCAGGTACTTCCCTGGAGGAAGTGTTATGGCCCCTCT
GGAAGACAGCAGGTCTGGCAGTGTGTATGTCAGAGGTCTTGAAAATGTGTATCAACCTGGAGGC
GGGGGTTTGGGGAGTCGCCTCAGGATCACCCAGGGAATGGATTTGAAAAAACTCATAAGCCCTC
AGAGATCCGGGCTGGGGGCTAGGTTGGGAGGAGCTGAGAACTTGTGCACCATTCCAAG[T/A]A
CATAGGTAGGCACGCAGTGCAGGCTGCTGCTCGTGGGAACAGCCTGATCGTACCACTTGGGGA
ATGGGTACATGACTTACGGTCACTCCTAGGACAGAGTGATGATCAGCCCTCCAAAATGATGTTCT
AAAGGATTTTTACCGATGTGGAGACAGTTCATGCTACATAAATAAAGCAGGTACAAAGCTATATA
TAATTTCAAAGAAGTTAAAAAAACCCAAACCCCAATAAAAACCCAATACACTTAAC

FIG. 8

C2225310T
[SEQ ID NO. 8]
CCAAGCTCCACAACAAGACCCCGCAATGAGAAGCCCACGCACCACAACTAGAGAAAGCCGTCAC
CCAGCAACAAAGACCCAGCACAGCCAAAAATGAAATAAAAACGAAAACAAAAACCGACTAGCCT
CTGTTCTCACCAATTCTTGCCTATCAGATAATGAACAAGCAAACAAATATGCAAAGTGGTGATAA
GTCGCCATCAGAAGCAAGAGCCAGGCAAAAGGACGGTGAGAGTGGAAGGTCTATCTT[C/T]AG
GAAGAGTTGCCAGGGAAGGCCTCTCTGACGTGGCGACATCTGCACGGAGACCAGCAGCACACA
AAGGAGCTTGACGACCACTGGGAAGCCAGACATTTCAATTTTCTCAACGCTTTCCATTAACACCC
CACAAACAAAACCCCTTCCTCTCTCCTAAGCACAAATATTTGCCTTTGGCCCATAGCTGAAAAATT
TTACATAAACCACCGCTTATTTAAACAGACCCACGACCACACGTTGATTCAATA

FIG. 9

G2288436A
[SEQ ID NO. 9]
CCTCTGGACACGCCAGTGCCTCCTGAGCCCAGCTATTGTCCTGCCAGGCCACACATTTCCAAGG
GCAGTGGCTAGCCCTCAGTCACCCTCTCTGGGTTAGTTGCCCATCCCTGGTCCCATCAGCTATGG
CAGGGAGACCGGTGGTATAGAGCCCCTTGGAAGCATCATTCTTAGGACAGCGGTGGCTGTCTTG
GGTGGATTAAGCCAGAGGAAAATTGAGTGTGGGAGGCCAACTGCATGAACACAGGAG[G/A]GT
GAACGTCTAATGAGCTCAGCTCTAATTACTGCTTGNNNNNNNNNNNNNNNNNNNNNNNNNNNN
NNNNNNNNNNNNNNNNNNNNNNNNNNNNNNNNNNNNNNNNNNNNNNNNNNNTGAGCAGTGAGACC
ATTACCACGATCGTTGAAAGAAACCCCCTACCCCTGGGCAGTCACCTTCCTTTGCTTCTCCCCAG
CCCTGGGCAACCACTAAATCTTCTGTCTATGAGTTTGTCTCTTGTGCCACATTTCACAT

FIG. 10

C2332892T
[SEQ ID NO. 10]
ATAGCAAGGAAGAAATGGGCAGGGAAGAGAAAAGAAGCTTTGGGAAGGAAGACAGCTGCTGCT
GCTGCTAAGTTGCTTCAGTCATGTCCGACTCTGTGTGACCCCACAGACAGCAGCCCACCAGGCT
ACCCTGTCCCTGGGATTCTCCAGGCAAGAAAACTGGAGTGGGTGCAAGGAAGACAGGGGACCT
GACAATTGATTGGAGGCGAAGCAAAGAATGGTGAAGAGGTCACGGGCCTCTGGCGTTTCG[C/T
]GGCCAAGACACAAGAAGGACAATGTCACTGAGAACTCAGGAGGCACAGGCAGGGGACAGGGG
TATGCAGGGGGGCCTTGAGAGGAAACCATCCGCATTCATTAGAGACACTCGGCATGCACCTATA
CATAAACGGGAGCCATAGGGCTGCAGGTGGTCGGGAATTCAGAACTGGGTGGGTCTGGGGAGA
CGGCTTAGGGCTGCGGGAGTCAGAGACCCAGCACTGGTCACTGAAGTCACGGCAGGCCGGG

FIG. 11

G2333140A
[SEQ ID NO. 11]
GTTGACAAAAGCTCAGAGTCCTGGGTAGGAAATGTGGGAACTAGAGCTGAGAAGTCATCTGGGG
CCAGATCAGGGGGCGTGGAGTCTCAGATTAAGAGAGCTGTGTTCCGCTTGTGTTTGGGGGAAAT
GCTGAACAGAAGATTCATTTGACAATGGTGTGTTCATTAGATCGAGGGGTAAGAATTAAAGTAGG
AAGACCAACTAAGCAATAACTCGGGCAAGAAACAAGGAAGCCTGAACAAGGATAAAT[G/A]GCA
AGGAAGAAATGGGCAGGGAAGAGAAAAGAAGCTTTGGGAAGGAAGACAGCTGCTGCTGCTGCT
AAGTTGCTTCAGTCATGTCCGACTCTGTGTGACCCCACAGACAGCAGCCCACCAGGCTACCCTGT
CCCTGGGATTCTCCAGGCAAGAAAACTGGAGTGGGTGCAAGGAAGACAGGGGACCTGACAATT
GATTGGAGGCGAAGCAAAGAATGGTGAAGAGGTCACGGGCCTCTGGCGTTTCGCGG

FIG. 12

C2338338T
[SEQ ID NO. 12]
AGGAATTAAGCCCATTCAGCACAACTACTGAGCCTGTGCTCCAGAGCCTGGGAGCCGCAAGCAC
TGAAGCCTGCACACCCTAGACCCCCTGGCTACATAAGTAGCCACTGCAATGGGAAGCCTGCCCA
CCACAGCTAGAGAATAGCTCCAGCTGCTCGTCACAACTAGGGAAAAGGCCATGCAGCAACAAAG
ACCCAGTGTAGCCAAAAAATAAAATAAATAACCATTAAAAAAAAAAAGAGTATTCCAT[C/T]AGG
AAACCTCATCTGAATAAAGAACAAACATATGTTTACACCTGAGCTAAAATATTTAACACTATAAAA
GGACTGCAGCCTTTTCAGTTTATCTTATTAGCTCACAATATATGGCAAACTCAGTTTATTTCTTTGA
GGATAGCAATAATCATTTTTCATAAGCTTATTGATGTCCATTTTGAGTGAATTTCTTTACAGAAAAT
AGGATTAATCATAACCACAAACTGTTTCCACGTTTATTGTGTTGGGA

FIG. 13

T2816109G
[SEQ ID NO. 13]
CCTAAATACCTCCCAAAGGATCTGCTTTCTAATGCCATCATATGAGGATTAGGTTTTAACATATGA
ATTCTTGGGTGGCACATTTAACTCATTGCAACCCCCTCTTCAACAGAGATAAGAAAAGCAACCCT
TTGTCTATACCAGTAAGTTATCCTCATATTAAATATTCCACTCATCTATTTCACTGTCCTGAAAGCC
GCAGATAGCACGGGCAACCCACATCTTCATAAATGCTCATGCTTGCCTACAA[T/G]AGAAGACAT
CAGTAAATCTGAGGTGAAGATGCTTGCCTTCCATGTATTAAAACTCCAGGAACAGGACAGTTAAT
ACTGCAGACTAAAATGGGTGTGTTGGGACTTCTCTGGCCATCCAGAGATGACTGAGCACCTCCA
CTGCAGGGCGCACGGGTTCGATCCCTGGTCGGAGAACTAAGATCCTGCAGGCTTTGCTTTGCAG
CCAAATAAATAAATAAATGAAATGGGTGTGTTGCACTGGCAACTTAAA

FIG. 14

C2816370G
[SEQ ID NO. 14]
AGTAAATCTGAGGTGAAGATGCTTGCCTTCCATGTATTAAAACTCCAGGAACAGGACAGTTAATA
CTGCAGACTAAAATGGGTGTGTTGGGACTTCTCTGGCCATCCAGAGATGACTGAGCACCTCCAC
TGCAGGGCGCACGGGTTCGATCCCTGGTCGGAGAACTAAGATCCTGCAGGCTTTGCTTTGCAGC
CAAATAAATAAATAAATGAAATGGGTGTGTTGCACTGGCAACTTAAATCCCATGAGA[C/G]TGTT
GCCATCAGTGATGGGATTCTCAGAAATGGTGACAGTTGTTGGTAATGCTCTCACAAGAGAATGTG
ATGTTTTTTCAATTTACATGGTTACCCAAATAGGATTCATTGCATATTCAGTTCAGTTCAGTCGCTC
AGTCGTGTCTGATTCTTTGCGACCCCATGAACTGCAGCATGCCAGGCCTCCCCGTCCATCACCAA
CTCCCAAGATCCACCCAAACTCATGTCCCTTGAGTCAGTGATGCCATCC

FIG. 15

HP-1013610
[SEQ ID NO. 15]
CTCCTCCATCCATGGGATTTTCCAGGCAAGAACACTGGAGTGGGTTGCCATTTCCTTCTCCAGGA
GATCTTCCCGACCCAGGGATAAAACCCGGGTCTCCCGCATTGTAGGCAGACACTTTACTGTCTGA
GCCACCAGGGGAGTCCAAGTTTGAAAGTCTGACTCTAAAGCCCATCTACTCTAACAGTGCATGTT
CAGTCTATGTACAACTTGCTTATATTTTTGAGATTATCTTCCATCATAAGAATTG[G/C]TACTACC
TATACTTTCATTAAGAAATAAAAAATGTAGTGCTTAAAAAATGGCAGGGCAGGGACACAGACGCA
GACACAGAGAACAGACTTGTGGACAGAGGGGGAAGGAAAGGGTGGGGCCAATGTACAGAGCA
GCGCTGACACGCACGCCATTGTTATGTACGGCAGGCGACTGAAGGGAAGTTGCTGTGCAACAG
GGAGCTCAGCCCAGCACTCTGCGACAACCTGGACGAGGGGCTGGGAGGTTCAA

FIG. 16

HP-1352705
[SEQ ID NO. 16]
TCTCAGTAATCATTAAGACTGACAAGAAGAGGCCTTTCTACCTCTCCGTCTGCTTAGGACCTCAG
GGACAACTGAAGCCTCCAGGGCGGCGAGTACGGTCAAAATGACAGGGCCTTTTAGGGTAGCCT
GCCTGGGGCAATTTCAGGCTTTCAAGAGAACAACCATAGTGATGAGTCTCATTAGCTGCCCGGG
GGTCAAGAAGAGAAAGACCCCAAGATTTCACACTTGAGAACTTTCTGATACAAACTGT[T/A]AT
GTGTGAGTAGGTGTGGCAGTTTTACTGCTTGTACTGTGAAAACCAATTTGATATTTGAATTTCCCC
ACCTGTGGACGTGGGCTGCTCAACTGGGTGCCTCTAAGTCACTTTCAGACACACTTTCTTCTACT
TGCTGGATCATTTTCTCCCAGGACTGTTGTGGAAACAAGAAACATAGCAACAGGTGAGCATCACC
CCCGGGAGGGCTCTTCTTCTAGCCCTTTTTTCCAGCTAATGAAGCGAAGCACC

FIG. 17

HP-1352905
[SEQ ID NO. 17]
AGAGAAAGACCCCAAGATTTCACACTTGAGAACTTTCTGATACAAACTGTTATGTGTGAGTAGGT
GTGGCAGTTTTACTGCTTGTACTGTGAAAACCAATTTGATATTTGAATTTCCCCACCTGTGGACGT
GGGCTGCTCAACTGGGTGCCTCTAAGTCACTTTCAGACACACTTTCTTCTACTTGCTGGATCATTT
TCTCCCAGGACTGTTGTGGAAACAAGAAACATAGCAACAGGTGAGCATCACCC[C/G]CGGGAG
GGCTCTTCTTCTAGCCCTTTTTCCAGCTAATGAAGCGAAGCACCTGCTGTTTGCCCATCGCAGAG
CCAGGCACTTTGCAGATAGTTGGGTTTTCAAGTACACTCCCAGCACTGCCCAGTTAGCCTGCTCC
CTCACTGAGTGAGTTCACTGTATCACTGTCCCGGAGAATCATTTCACGTCTCCTTATTTCTCCCCC
AAACTCCTCTGCTCCCTCCTTTAGCTGATGACATTTATTAGGAATGGA

FIG. 18

HP-1356048
[SEQ ID NO. 18]
ACCCACGGACATGTAGAGGCCTTGATATCTCCNNNNNNNNNNNNNNNNNNNNNNNNNNNNNNN
NNNNNNNNNNNNNNNNNNNNTAGAAGCTGTCCTGGGAAAGGGATCTGCCTGGCCAGGAGTGG
TTTGGTGTACAACCTCGGTGCTCACTGAGCGGACTTTGGTTTTCTTGGAAAACTAAAAGACAAGC
CTCTGACTGCTAACCATGTTATCTGTATAACTGGAGATGATTTCAGTGGTATTTCCCTCTT[G/A]
AAAAAAGATAAATTGTGCCACTTGAGTGCAGCTGTCACTGATTGGGTCTATGTGAACAGGATAAA
AGAGTTATGTTCCCCAGCAGCTCTGTGATAAATTGTTGAAGAGCCACAGCAATAAACAAGAAAAG
CTGACCACAGGAATGTCCCAGACAGAAAGGAAAAGGCCAGCAAGGAGGCTCCCTAGGGGGCTG
TCATGGTCTCTCGGGGACCATAGTCAGACTCTCTGCTGTGGTGCAGCCCACACACCA

FIG. 19

HP-1431709
[SEQ ID NO. 19]
CAAGGTGTTTTTAGGGAAAGGACAGGGAAATTAGACCTCAGCTTCAGTTCTGCCACAGAACTGT
GTGGCGTTGAGGAGGTTACTAAACCACTCTGAGCTACAGTTTCCTCATCTGGAGAACGGGAATA
ATGCCTACTTTTCAGACTCTTTTGATCATCAGATGAATTAATATATATGAAAGCAGTTTCTGAAGT
GTAGATTCATATCATTAATGAAGTAGGATAATCTTATTTTCTGATTTTTGCAAGGT[G/A]ATCTTG
AGTAACATCACCTTACAAAAATGACATCCTGGAGACCTTTATTCCTCATTGGGTCTTTTTCTCCTC
ATTTGTCAAAGGAAGTTGCTAGACTAGATTTCATGGTTAAAGATGTGTGTGTTTATACATGTGCAT
GTAATTTTGAATAAATCATTTGCCTGAGTAACTTATAAATAACTTTTTCTTGCCAAGCCTATGATAT
TTCTATCTGTGTTTTTAAGATTTGAAGACCAATTCTCAAAGACTC

FIG. 20

HP-1438531
[SEQ ID NO. 20]
CTCAGAGCGACAGTCATAAATTGAGCCTGGAGAGAGTATTGTTTGCTTTTCTAACATGTTTTTCTT
CTTTCCAGTGCACATCAGCCTCGTGTTTGGTATTTCGTATGTTGCGCCTGGTAAGAGATTTTCTTG
ACTTAACAAAATTTTGTCTAAGGGTGTGAGTGGGGGAGCAACCATTTAGAAGTCAAAAAATGTGG
GAAATTGGATTTCTGAGTCCAAATCTGTTGCCATTTTGTTTGAATCTTTTTCC[T/C]CAAATACTT
TCTCTGTAGAAGGAGAATTTAGCCAATTCTGATTTTCACATTTGTCTCATAAAACTATTACAGGAA
ATTAACACTAGAGTTAATTTTTAAACCCCTTAAAGGAATTGTTCTTGTGGTTGTCGTTTAGTCGCT
CAGTCGTTCGATTCTTTTGTGACCCCATGGACTGTAGCCCACCAGACTCTTCTGTGTATGGGATT
CTCCAGGCAAGAATACTGGAGTGGGTTGCCACTTCTCCCCCAGG

FIG. 21

HP-1731905
[SEQ ID NO. 21]
TGGTTGAAGTGGGAAGAGGGTGAGTGAGGACCCTAGAGGCAGGAGAAGGTTACAAGAAAGGCA
CCCCACCTCTCCCAGCAACTTGGCATTGCCCTTCTCTCGATCCGCCAGGGCTGAGCCTTGCAGTA
CCCTTAGGGACCACCCGAATTCCTCAGAACACAGTTTGGAAACCACTTAGTGGCTCTTTTCCTTC
TCCTTCATCCATGCATCTTCCAAAGACTTTCCAAGCTCCTCACTTGGAGGGGTATTC[A/G]AGGT
GCTATGAGACATGAAAATGCCCACATCATCCTTTCCGTCCTCAGTAGAGCAGAGGCTGTCTATCT
AGAAAAGGCTGGATCAGAGCTTTGTTGGAGAATTGCTGAACAATGCAACGAAATGAGTATGTCT
GGGGGTGGGCAACAGCAGGAAGTAGTTGTTCTGTGTGGGTTTGAGGAACAGCAACTCTCTCAGA
GATGGAGACGCTTAACCAGAGAGGAGTAACTCTGGGCCCTGGAAGAAACCTAC

FIG. 22

HP-1872077
[SEQ ID NO. 22]
GGGCTAGCCTGGGAATGTAATAACCCCTTTATAACACTACTCGCATGGGTAAATACATCCAGATT
ACTTATAGATAATTAACAGAAGAATTTTTAGGGCTCAGTCCATTTGGAAGTTTAAGACTGGAAAGT
GAAGACACTCTGTATGATGGGGTTAACATAAAATGCTTTTATGTGTGTTCATACAAAGAACCAAG
GCAATATTTTTCATTAATTTTCCCTGGAGAATAGCTGCTTTACAAAGTTGTGTC[A/G]GCTTCTG
CTCTCAGCAAAGTGAATCACCAAACGGATACATGTATCCTCCCTTTTTTGGATTTCCTCCCGTTTA
AGTCACCAGCAAGCACAGAGGAGAGTTCGCAGTGCTGGACAGTGGGTTTTCATCAGTTATCTATT
CTATAGATAGTATCCATTTTTAAAAATTAAACTGACTCATCATTGGACAAAGAAAATCTTCCTTCAC
AGAAACCCAACTCCACACTAAAATGGGATATAAAGAATTTGTGGC

FIG. 23

HP-1872200
[SEQ ID NO. 23]
CTGGAAAGTGAAGACACTCTGTATGATGGGGTTAACATAAAATGCTTTTATGTGTGTTCATACAA
AGAACCAAGGCAATATTTTTCATTAATTTTCCCTGGAGAATAGCTGCTTTACAAAGTTGTGTCAGC
TTCTGCTCTCAGCAAAGTGAATCACCAAACGGATACATGTATCCTCCCTTTTTTGGATTTCCTCCC
GTTTAAGTCACCAGCAAGCACAGAGGAGAGTTCGCAGTGCTGGACAGTGGGTT[T/C]TCATCA
GTTATCTATTCTATAGATAGTATCCATTTTTAAAAATTAAACTGACTCATCATTGGACAAAGAAAAT
CTTCCTTCACAGAAACCCAACTCCACACTAAAATGGGATATAAAGAATTTGTGGCAATTATGGTAC
AAACACCTAAACCCAGAAGGCAGAAAGTTGGAACGTATTGAATGCATGATACCGTAATGATAAGA
AATAGTTCTACCATGAAATAACACGTATTTTTCTCTTAGCCTTAAC

FIG. 24

HP-2101528
[SEQ ID NO. 24]
CACTAATGTGGAAGTTCATACAGAAAAGAAGGAAGTCAGGAATTAATTTCTAAGCGGATCTGTCT
TACTCCTTTGGATATGAGCGAAGAAACCGATTTGAGCTGGTTTAAGCCCGAAGTGAGTTGGTTGG
GGAGGTAGCCTACGGGTAGAAAGCCATCTTCAGAAGCCAGACCAGGAAAGAAAGCCTCAGGGC
GGGACTAAACTGGAACTTCGCGAGCATGGAGTCTCTCTGTCTGTCTGTCTCTCTGCT[C/T]CTC
TCTCTCCCCTCTACGGCTTTTCTCTGAGCCTGGGCTAGATGGCATACAGTCATCCCCACAACCCA
GGCGATTCTTAAGTTACACTTTTCTGTCCTAACAATTTATAAAGACTACCAATCTGGCAACTTCCT
TCCAAATTCCTACCAGAGAGCTGTTTCTTTGGCTGGACTGGGGTCAGGTAGCCCCCTCCTGTGAT
CTGCCTTGGCCAGAGACCATGTGACATGATATGATTATAAACTTGGCTGCC

FIG. 25

HP-2128551
[SEQ ID NO. 25]
CCCACTCTCATCCTCAGTGGGCCATCCTAAAGCAGCATCTTTCCTGAGAGAAAGAAGAGGGCTT
GGTGGGAGCAGCCTTTTCTGTCCTTTTTTTTTTCCGGCCATTGTATGCAGCGTGTGAGATCTCAG
TTCCCCGACCAGCGATTGAACCCGCGCCTCCTGCACTGGGAGCTTGGAGTGTTAACCACTGGAC
CTCCAGGGAAGTCTCCAGCCTCTTCCATGCTGAGTCTTGCACCTTTCTCCACTGACT[T/C]CCCC
CCTTTCTAACGCACACCAGTTTTGTGGTTAACCGGTTGCAGTCCCAAAGTAATTGCTGTTCCATGA
GGAGGTCACACCTCCAGGCATGGAGGGCCTGAGAGAAGTGTAGGTAATTACAGGTTCCTGGGA
ATACTTGAAAAACTTGTTGGAAAGACAGCAGTGTGCTAGCAAAGACATTTAGCCAACGGTCAGG
GATGAAATTTTGGAAAATTCTGCACTGCCACCACAATGCAGTAATTCATTCAA

FIG. 26

HP-2214142
[SEQ ID NO. 26]
TGTTTTTCCACCGTGTCAGGAATCTGAACTTTGGGGTTCTCTGGGACATAAAAGATGGATGCCAGC
GGGTGAGAACTAACTTCCGTTTCAGTTCAAAATCCATTGCTGGCAGCACCCGTGAGAGGGTCTCT
GCTGTGCTCACATGGGATAGAAAGACCTAGAATGGCAGTTCGGGACCAGCACTCCAGAGCCCTG
ATTCCCAGGACTTCAGTGGACAGAGAACCCCAAACATCGGGAGCCTTTCCAACTCA[A/T]GGG
GGAAGGATGAAACCTAATTTCATTTTACCAGGCAAGTTTTAGCATTTTGCCAGAATTCTTTTCGAG
TTTAAGGCGTGTGAAGACCAGGATAAGTGAACTGTGCTTGAATCAGGTGGCACGTAGGTTTGAA
CGGTGAGGCATCCAGATGGCTTAGAAGCAGTGGTCGCTTGAAGCAGTTACTGAGGACAGGGAT
AGTATCCGAGTCACCTCTGTGTCCTCCCAGCCTGAGGTTATGACACCTTGAGTG

FIG. 27

HP-2220054
[SEQ ID NO. 27]
TCACAACAGTTATTTGTCCCCAGATGTCAGTAGTCCTGAGATTGAAAAAGTTCCTGGATTCAAAG
CAGAGCAAGTCATGAGATTACAGGTTTTTTCACCTACCAAGTTGGCCTTGACTTTTCAGACCTGAT
ACTCAGCACCAGCAAAGAATCAGGTACTTCCCTGGAGGAAGTGTTATGGCCCCTCTGGAAGACA
GCAGGTCTGGCAGTGTGTATGTCAGAGGTCTTGAAAATGTGTATCAACCTGGAGG[C/T]GGGG
GTTTGGGGAGTCGCCTCAGGATCACCCAGGGAATGGATTTGAAAAAACTCATAAGCCCTCAGAG
ATCCGGGCTGGGGGCTAGGTTGGGAGGAGCTGAGAACTTGTGCACCATTCCAAGAACATAGGT
AGGCACGCAGTGCAGGCTGCTGCTCGTGGGAACAGCCTGATCGTACCACTTGGGGAATGGGTA
CATGACTTACGGTCACTCCTAGGACAGAGTGATGATCAGCCCTCCAAAATGATGTT

FIG. 28

HP-2220178
[SEQ ID NO. 28]
GACCTGATACTCAGCACCAGCAAAGAATCAGGTACTTCCCTGGAGGAAGTGTTATGGCCCCTCT
GGAAGACAGCAGGTCTGGCAGTGTGTATGTCAGAGGTCTTGAAAATGTGTATCAACCTGGAGGC
GGGGGTTTGGGGAGTCGCCTCAGGATCACCCAGGGAATGGATTTGAAAAAACTCATAAGCCCTC
AGAGATCCGGGCTGGGGGCTAGGTTGGGAGGAGCTGAGAACTTGTGCACCATTCCAAG[A/T]A
CATAGGTAGGCACGCAGTGCAGGCTGCTGCTCGTGGGAACAGCCTGATCGTACCACTTGGGGA
ATGGGTACATGACTTACGGTCACTCCTAGGACAGAGTGATGATCAGCCCTCCAAAATGATGTTCT
AAAGGATTTTTACCGATGTGGAGACAGTTCATGCTACATAAATAAAGCAGGTACAAAGCTATATA
TAATTTCAAAGAAGTTAAAAAAACCCAAACCCCAATAAAAACCCAATACACTTAAC

FIG. 29

HP-2225310
[SEQ ID NO. 29]
CCAAGCTCCACAACAAGACCCCGCAATGAGAAGCCCACGCACCACAACTAGAGAAAGCCGTCAC
CCAGCAACAAAGACCCAGCACAGCCAAAAATGAAATAAAAACGAAAACAAAAACCGACTAGCCT
CTGTTCTCACCAATTCTTGCCTATCAGATAATGAACAAGCAAACAAATATGCAAAGTGGTGATAA
GTCGCCATCAGAAGCAAGAGCCAGGCAAAAGGACGGTGAGAGTGGAAGGTCTATCTT[T/C]AG
GAAGAGTTGCCAGGGAAGGCCTCTCTGACGTGGCGACATCTGCACGGAGACCAGCAGCACACA
AAGGAGCTTGACGACCACTGGGAAGCCAGACATTTCAATTTTCTCAACGCTTTCCATTAACACCC
CACAAACAAAACCCCTTCCTCTCTCCTAAGCACAAATATTTGCCTTTGGCCCATAGCTGAAAAATT
TTACATAAACCACCGCTTATTTAAACAGACCCACGACCACACGTTGATTCAATA

FIG. 30

HP-2288436
[SEQ ID NO. 30]
CCTCTGGACACGCCAGTGCCTCCTGAGCCCAGCTATTGTCCTGCCAGGCCACACATTTCCAAGG
GCAGTGGCTAGCCCTCAGTCACCCTCTCTGGGTTAGTTGCCCATCCCTGGTCCCATCAGCTATGG
CAGGGAGACCGGTGGTATAGAGCCCCTTGGAAGCATCATTCTTAGGACAGCGGTGGCTGTCTTG
GGTGGATTAAGCCAGAGGAAAATTGAGTGTGGGAGGCCAACTGCATGAACACAGGAG[G/A]G
TGAACGTCTAATGAGCTCAGCTCTAATTACTGCTTGNNNNNNNNNNNNNNNNNNNNNNNNNNN
NNNNNNNNNNNNNNNNNNNNNNNNNNNNNNNNNNNNNNNNNNNNNNNNNNTGAGCAGTGAGA
CCATTACCACGATCGTTGAAAGAAACCCCCTACCCCTGGGCAGTCACCTTCCTTTGCTTCTCCCC
AGCCCTGGGCAACCACTAAATCTTCTGTCTATGAGTTTGTCTCTTGTGCCACATTTCACAT

FIG. 31

HP-2332892
[SEQ ID NO. 31]
ATAGCAAGGAAGAAATGGGCAGGGAAGAGAAAAGAAGCTTTGGGAAGGAAGACAGCTGCTGCT
GCTGCTAAGTTGCTTCAGTCATGTCCGACTCTGTGTGACCCCACAGACAGCAGCCCACCAGGCT
ACCCTGTCCCTGGGATTCTCCAGGCAAGAAAACTGGAGTGGGTGCAAGGAAGACAGGGGACCT
GACAATTGATTGGAGGCGAAGCAAAGAATGGTGAAGAGGTCACGGGCCTCTGGCGTTTCG**[C/T
]**GGCCAAGACACAAGAAGGACAATGTCACTGAGAACTCAGGAGGCACAGGCAGGGGACAGGGG
TATGCAGGGGGGCCTTGAGAGGAAACCATCCGCATTCATTAGAGACACTCGGCATGCACCTATA
CATAAACGGGAGCCATAGGGCTGCAGGTGGTCGGGAATTCAGAACTGGGTGGGTCTGGGGAGA
CGGCTTAGGGCTGCGGGAGTCAGAGACCCAGCACTGGTCACTGAAGTCACGGCAGGCCGGG

FIG. 32

HP-2333140
[SEQ ID NO. 32]
GTTGACAAAAGCTCAGAGTCCTGGGTAGGAAATGTGGGAACTAGAGCTGAGAAGTCATCTGGGG
CCAGATCAGGGGGCGTGGAGTCTCAGATTAAGAGAGCTGTGTTCCGCTTGTGTTTGGGGGAAAT
GCTGAACAGAAGATTCATTTGACAATGGTGTGTTCATTAGATCGAGGGGTAAGAATTAAAGTAGG
AAGACCAACTAAGCAATAACTCGGGCAAGAAACAAGGAAGCCTGAACAAGGATAAAT[A/G]GC
AAGGAAGAAATGGGCAGGGAAGAGAAAAGAAGCTTTGGGAAGGAAGACAGCTGCTGCTGCTGC
TAAGTTGCTTCAGTCATGTCCGACTCTGTGTGACCCCACAGACAGCAGCCCACCAGGCTACCCTG
TCCCTGGGATTCTCCAGGCAAGAAAACTGGAGTGGGTGCAAGGAAGACAGGGGACCTGACAATT
GATTGGAGGCGAAGCAAAGAATGGTGAAGAGGTCACGGGCCTCTGGCGTTTCGCGG

FIG. 33

HP-2338338
[SEQ ID NO. 33]
AGGAATTAAGCCCATTCAGCACAACTACTGAGCCTGTGCTCCAGAGCCTGGGAGCCGCAAGCAC
TGAAGCCTGCACACCCTAGACCCCCTGGCTACATAAGTAGCCACTGCAATGGGAAGCCTGCCCA
CCACAGCTAGAGAATAGCTCCAGCTGCTCGTCACAACTAGGGAAAAGGCCATGCAGCAACAAAG
ACCCAGTGTAGCCAAAAAATAAAATAAATAACCATTAAAAAAAAAAAGAGTATTCCAT[T/C]AGG
AAACCTCATCTGAATAAAGAACAAACATATGTTTACACCTGAGCTAAAATATTTAACACTATAAAA
GGACTGCAGCCTTTTCAGTTTATCTTATTAGCTCACAATATATGGCAAACTCAGTTTATTTCTTTGA
GGATAGCAATAATCATTTTTCATAAGCTTATTGATGTCCATTTTGAGTGAATTTCTTTACAGAAAAT
AGGATTAATCATAACCACAAACTGTTTCCACGTTTATTGTGTTGGGA

FIG. 34

HP-2640799
[SEQ ID NO. 34]
TGTGAGTGTCCAAGAGTCTGCAGTGGATGCACGGGAAGACACTGGCCTGCCACGGGTCAGGGG
CACTGAATACAAGAGTTCCAGGAGCCATGGTGTGCTGGCCTACGTCCTTTTGAAGGAGGTTGCC
ATTACCCCTACCGTAGTTTGGCCTCACAGGGAGGGAACACAGCTCCATCCATCAACAGAAAACTG
GACATCTCTGTTGCTTACCCTCAAAGGACCTAAACAGCAACCCAGGCTTTTTCAGAGT[T/A]TGA
TTACCCAGAAGAGCTAAGAACAGACTGGATGTGAGTTTTTGTTCTATTTTCAGAACCAAGCACTC
TGCACCATCACAAATTGCTGATGAGCACAAGTAATTTTAGTTCAGATCTCTACCAGTGAATTTTCT
TTCTTTGGACATCACAAATATTGCATTAGTATCCAAAAAGGACTTTGAAAACATCCTTGGAGCTCT
TTGAAGTCTGTGTGAGGGTCTTGAATATCCCTATGACTCATGAGCAAAAG

FIG. 35

HP-2648129
[SEQ ID NO. 35]
TTGAAGTGAATTGCAAACCAAACAAGAGAACAAACTGCAGTCATTTCCTGGATCTGAAACCAAAT
CTTAATATGAACTGTTTACTGAAATGTGAACCAGCTAAAGTTTGAGAGTAATTTCCAAACACACCT
GAGGATTTGGTCTAATCACGTAACCGAACCCATATATATTTAAAAGCTTTTGAACAGACTTGGAAA
CTCACATTGCTAAACAAATCTCAGAACAAACTCAAATGAAACTAATAGTTCTT[T/C]ACAGTGAG
CTGACTAAGGAACACACAATAGAAATGTGATGATCGACCTTCTTTTTTCCGAGTCAACATTATAAT
GAGTTGAGTTTTAACACAATTCAGTCTGCAATTATTTTTCCAAGAGGGACTATACGATCCTTTTGA
TAGGTGTGTATTGTGTGCAGGAGGAGGAAGGAGGAAGTTAGGGGGTCGGGATTATAATGGACA
AGGAAAGGACTCAGAGGCGATGAAGCGAAGTGTGTCCTTAGAGACGG

FIG. 36

HP-2650867
[SEQ ID NO. 36]
CTTCAAACGTCCCTATTGCTAATTTTCTCCTCTCTCTTTCTACCATATGCTGTCCCTCCCGTTCAGA
ACTTAATGAACAACGTGCCTCAGTCTGCTGGTCCCCATTCTGAGCCCCTTTCACCCACTTCATGC
CAGATGACTGCTCTGCAAATTATTTGGCCACAGAAAGTTTATCCACCCAACATCTAGTCTTGTCTT
GAGGATGGTGTTCCACTAAGCACACACAGGGAAATGCTGCTTTAAACAGTGC[T/A]GGATATGC
TTTGTTCATTCTTACCTGCATTTCCTTTTTAAGAATTTAAATATTTATTTAGTTATTTATTTTGGCTG
TGCTGGGTTGTTGTTGCTGAGCGGGTGGGGCTACTGTCGTTACGGTGCACAGGCTTCTCATTG
CAGAAAGCAGACCCCAGGGCACTCAGGCTTCGGTGGTTGCAGCGAGTGGGTTCCATAGTTGTG
GCACATTGACTTGGTTACCCTGCAGCACGTGGAATCTTCCTGGGTCA

FIG. 37

HP-2651006
[SEQ ID NO. 37]
GTGCATTGAAGGTTCTCAAACAGGTTAGTTCCCCTAATCCCCTTTTCCTCTGCCGCCAGACTACCT
CTCCTCCCGGCTTCCTGGCTTCTGTTACATCACCACCATCGTCCGGCTTTCCACGCTGCGTCTTG
GCGTCTCCCCTTCAAACGTCCCTATTGCTAATTTTCTCCTCTCTCTTTCTACCATATGCTGTCCCTC
CCGTTCAGAACTTAATGAACAACGTGCCTCAGTCTGCTGGTCCCCATTCTGA[G/T]CCCCTTTCA
CCCACTTCATGCCAGATGACTGCTCTGCAAATTATTTGGCCACAGAAAGTTTATCCACCCAACATC
TAGTCTTGTCTTGAGGATGGTGTTCCACTAAGCACACACAGGGAAATGCTGCTTTAAACAGTGCT
GGATATGCTTTGTTCATTCTTACCTGCATTTCCTTTTTAAGAATTTAAATATTTATTTAGTTATTTAT
TTTGGCTGTGCTGGGTTGTTGTTGCTGAGCGGGTGGGGGCTA

FIG. 38

HP-2657651
[SEQ ID NO. 38]
ATGCATGCATGCTAAGGCGCTTCAGCCGTGTCTGACTTTGTGCGACCCTACAGACAGCAGGCCA
CCAGCCTCCTCTGTCCACGGGATTCTCTAGGCAACAAAACTGGAGTGGGTTGCCATTTCCTTCTC
CAAGGTGGCTGTCTACAAGCCAGGAAAAGAAACCTCAGTGGAACTTGACCACGCTGGCATCCTG
ATCCAGACTTCCAGCCTCCAGAACTGTGAGAAAATTAACTTCTGGTGGTTAAACCAC[G/C]CCTT
CGGGTTATGGTAGTCAAGCTAAGACACTTGCTTATAGGTGACCTAGAAGTCTCACCTTTAAACCA
ATAAAGCATGTCAGAAGACACTGTGCAGAGATCAAATGTGGCTGCTCAGGTGGGTTAAATTCAA
GAAGGCATCAGGGACTTCCCTGGCAGTTCAGTGGTTGAGATTTTGCCATTCAATGCACGGGGTC
CAGGTTCAGCCCCTGGTTGGGGAGGTAAGATCCCACAGGGCTCATAGCCAAGA

FIG. 39

HP-2676311
[SEQ ID NO. 39]
CTGCCATATCACTAAACAAAGGATGTCGCAGACATCAGTAATTGCAGCCATCATAAATGGTGAGC
TAGTGAGCCCTGAGGGAACTCAGGAAGGAAAGAATAGCTGCCATCTAGTAGCCATCAGACCACA
GCCACTCCCTGCAGTGAGCCCTGAGGACCCTCAAGATGTGAAAATACAGGATCCCGGCCCCCCC
GAGACTGGAAGTGCTTATCAAAGGAGTGAGTTCAGTGAGGCCAGACTCTTGCTCTTC[T/C]CAT
ACACCGCAAGGTGCTAAATTCCTTAACTTGGGACAGCTGGTTTTCTTTAATTTATAATAATCTTTT
GACGTTCAGACTACCTGCCTTTGTAGGTAGTCACATACTTCTACATAACCTAGCTCTCCTCCTCAC
CTCCCTGGAGCAGTTCCTTCAGGGTTATTTGATATGTTTCCTCCTGGGCTTGAAGTCCTAAAAATT
CCTGCCGATTAAAACATAACTCTCAACTTTTAAGTTGTGAACATTTTTT

FIG. 40

HP-2816109
[SEQ ID NO. 40]
CCTAAATACCTCCCAAAGGATCTGCTTTCTAATGCCATCATATGAGGATTAGGTTTTAACATATGA
ATTCTTGGGTGGCACATTTAACTCATTGCAACCCCCTCTTCAACAGAGATAAGAAAAGCAACCCT
TTGTCTATACCAGTAAGTTATCCTCATATTAAATATTCCACTCATCTATTTCACTGTCCTGAAAGCC
GCAGATAGCACGGGCAACCCACATCTTCATAAATGCTCATGCTTGCCTACAA[T/G]AGAAGACA
TCAGTAAATCTGAGGTGAAGATGCTTGCCTTCCATGTATTAAAACTCCAGGAACAGGACAGTTAA
TACTGCAGACTAAAATGGGTGTGTTGGGACTTCTCTGGCCATCCAGAGATGACTGAGCACCTCC
ACTGCAGGGCGCACGGGTTCGATCCCTGGTCGGAGAACTAAGATCCTGCAGGCTTTGCTTTGCA
GCCAAATAAATAAATAAATGAAATGGGTGTGTTGCACTGGCAACTTAAA

FIG. 41

HP-2816370
[SEQ ID NO. 41]
AGTAAATCTGAGGTGAAGATGCTTGCCTTCCATGTATTAAAACTCCAGGAACAGGACAGTTAATA
CTGCAGACTAAAATGGGTGTGTTGGGACTTCTCTGGCCATCCAGAGATGACTGAGCACCTCCAC
TGCAGGGCGCACGGGTTCGATCCCTGGTCGGAGAACTAAGATCCTGCAGGCTTTGCTTTGCAGC
CAAATAAATAAATAAATGAAATGGGTGTGTTGCACTGGCAACTTAAATCCCATGAGA[C/G]TGTT
GCCATCAGTGATGGGATTCTCAGAAATGGTGACAGTTGTTGGTAATGCTCTCACAAGAGAATGTG
ATGTTTTTTCAATTTACATGGTTACCCAAATAGGATTCATTGCATATTCAGTTCAGTTCAGTCGCTC
AGTCGTGTCTGATTCTTTGCGACCCCATGAACTGCAGCATGCCAGGCCTCCCCGTCCATCACCAA
CTCCCAAGATCCACCCAAACTCATGTCCCTTGAGTCAGTGATGCCATCC

FIG. 42

HP-2820224
[SEQ ID NO. 42]
TTAATACGGGGAAGAATTTTACTAGATGTTTTAAATTTTGGAGTTGCCTGAGTATAAATGCCTCTA
GACAGCTCCCCAAACCATGCTTTATAGACTGCTAAAGCAGTTCTTTTTTTTTTTTTTTTTCTTATTT
CTTGGTCACAGTGAGTTTCTCTCATTGAGTTAAATACATATGGTTTGGAATACAGTTAAGTCCCCT
ACATACAAATGAGTTCCATTTTGAGAGTGCGTTCGTAAAGCCAATTTTTTC[T/G]CAAGTCCAAC
AAAGTTAGCCTAGGTACCTACTCAACTAACACAGTCGTGCATATAGGACTGTACTATGACAGGTT
TATAATACTTTTCACCCAAATAATACATGAAAAACAAGCAAAGTATAAAGAAACCTTAAAAAATAT
ATTTATTTATTCATTTGTCTGCACTGGGTCTTTAGTTGTAGCGTGTGAACTCTTGCTGCCTGTGGG
ATCTAGTTCCCTGACCAGGATTTGAAACCAGGGGACCTGCATT

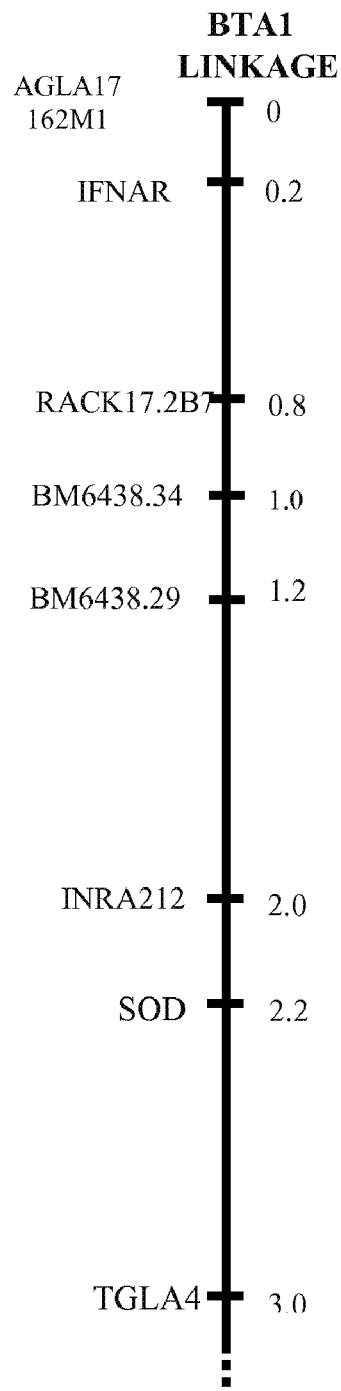
FIG. 43. Linkage Map of Bovine Chromosome 1

FIG. 44. *Polled* SNP Allele Frequencies in Bovine breeds

| SNP | Combined | Angus | Brahman | Charolais | Gelbvieh | Hereford | Holstein | Jersey | Limousin | Red Angus | Simmental |
|---|---|---|---|---|---|---|---|---|---|---|---|
| G49284C | 0.09 | 0.19 | 0.10 | 0.03 | 0.06 | 0.00 | 0.22 | 0.00 | 0.03 | 0.21 | 0.07 |
| T39385A | 0.19 | 0.18 | 0.37 | 0.20 | 0.25 | 0.13 | 0.44 | 0.05 | 0.09 | 0.13 | 0.17 |
| A39381G | 0.36 | 0.46 | 0.03 | 0.34 | 0.25 | 0.65 | 0.28 | 0.10 | 0.20 | 0.39 | 0.39 |
| C39382G | 0.19 | 0.18 | 0.37 | 0.18 | 0.25 | 0.13 | 0.44 | 0.05 | 0.09 | 0.13 | 0.17 |
| G69199A | 0.05 | 0.00 | 0.03 | 0.14 | 0.00 | 0.00 | 0.33 | 0.00 | 0.06 | 0.00 | 0.04 |
| T69211C | 0.09 | 0.00 | | 0.00 | 0.03 | 0.00 | 0.39 | 0.00 | 0.03 | 0.00 | 0.11 |
| A43281G | 0.07 | 0.00 | 0.46 | 0.02 | 0.00 | 0.09 | 0.44 | 0.05 | 0.03 | 0.00 | 0.02 |
| A10273G | 0.11 | 0.01 | 0.03 | 0.18 | 0.09 | 0.03 | 0.28 | 0.10 | 0.34 | 0.00 | 0.20 |
| T10275C | 0.12 | 0.00 | 0.07 | 0.18 | 0.09 | 0.06 | 0.28 | 0.10 | 0.34 | 0.00 | 0.20 |
| T100032C | 0.30 | 0.11 | 0.07 | 0.41 | 0.28 | 0.57 | 0.11 | 0.85 | 0.22 | 0.18 | 0.22 |
| T9868C | 0.33 | 0.79 | 0.10 | 0.06 | 0.33 | 0.00 | 0.22 | 0.00 | 0.34 | | 0.48 |
| T49320A | 0.18 | 0.30 | 0.00 | 0.09 | 0.09 | 0.27 | 0.00 | 0.25 | 0.19 | 0.26 | 0.13 |
| T49278C | 0.19 | 0.29 | 0.23 | 0.09 | 0.09 | 0.27 | 0.00 | 0.25 | 0.19 | 0.26 | 0.13 |
| T49279A | 0.17 | 0.28 | 0.00 | 0.09 | 0.09 | 0.27 | 0.00 | 0.25 | 0.19 | 0.26 | 0.13 |
| C49249T | 0.18 | 0.28 | 0.03 | 0.09 | 0.09 | 0.27 | 0.00 | 0.25 | 0.19 | 0.26 | 0.13 |
| G44231A | 0.44 | 0.26 | | | 0.41 | 0.52 | 0.39 | 0.05 | 0.47 | 0.26 | 0.50 |
| C79182T | 0.17 | 0.01 | 0.30 | 0.24 | 0.13 | 0.11 | 0.44 | 0.05 | 0.44 | 0.00 | 0.22 |
| G69234A | 0.36 | 0.71 | 0.03 | 0.33 | 0.41 | 0.23 | 0.44 | 0.00 | 0.19 | 0.58 | 0.33 |
| C59230T | 0.12 | 0.19 | 0.00 | 0.13 | 0.10 | 0.23 | | 0.00 | 0.00 | 0.13 | 0.07 |
| A15434T | 0.11 | 0.00 | 0.00 | 0.11 | 0.03 | 0.52 | 0.00 | 0.00 | 0.06 | 0.00 | 0.02 |
| T15431A | 0.15 | 0.24 | 0.00 | 0.12 | 0.31 | 0.02 | 0.00 | 0.55 | 0.03 | 0.26 | 0.09 |
| G15428C | 0.20 | 0.24 | 0.73 | 0.12 | 0.31 | 0.02 | 0.00 | 0.55 | 0.00 | 0.26 | 0.09 |
| C15424T | 0.05 | 0.00 | 0.08 | 0.06 | 0.00 | 0.03 | 0.00 | 0.55 | 0.00 | 0.00 | 0.00 |
| T110337G | 0.12 | 0.00 | 0.00 | 0.09 | 0.06 | | 0.22 | 0.00 | 0.09 | 0.03 | 0.07 |
| C110341G | 0.11 | 0.01 | 0.00 | 0.09 | 0.06 | 0.44 | 0.22 | 0.00 | 0.09 | 0.03 | 0.07 |
| T110336G | 0.09 | 0.00 | 0.43 | 0.00 | 0.00 | | 0.13 | 0.00 | 0.00 | 0.00 | 0.00 |
| A34585C | 0.19 | 0.20 | 0.17 | 0.27 | 0.28 | | 0.00 | 0.00 | 0.06 | 0.24 | 0.13 |
| T69220G | 0.04 | 0.00 | 0.00 | 0.06 | 0.03 | 0.02 | 0.33 | 0.00 | 0.03 | 0.00 | 0.04 |

FIG. 45

Mode of *Poll* Inheritance

| Genotype | Males | Females |
|---|---|---|
| PP ScSc | Scurred | Scurred |
| PP Scsc | Polled | Polled |
| PP scsc | Polled | Polled |
| Pp ScSc | Scurred | Scurred |
| Pp Scsc | Scurred | Polled |
| Pp scsc | Polled | Polled |
| pp ScSc | Horned | Horned |
| pp Scsc | Horned | Horned |
| pp scsc | Horned | Horned |

Horned = Hollow, bony growths that are fused to the skull. Sinus cavity pervades into the horn
Scurred = Loose, "cartilaginous" growths
Polled = No growths

FIG. 46

Sequence of *Bos Taurus* Chromosome 1 (bases 1 thru 3,000,000)
[SEQ ID NO. 43]
(See electronic compact disk sequence listing. File name: Btaurus Chm 1 seq.txt)

FIG. 47

Comparison of horn/poll marker coordinates in successive releases of the bovine genome sequence. Markers in the disclosure are identified by their location in Btau3.0

| Btau3.0 coordinate | Btau3.1 coordinate | Btau4.0 coordinate |
|---|---|---|
| 1013610 | NA | 1008610 |
| 1352705 | 306920 | 1338205 |
| 1352905 | 307119 | 1338405 |
| 1356048 | 310281 | 1341564 |
| 1431709 | 385924 | 1417209 |
| 1438531 | 392746 | 1424031 |
| 1731905 | 686119 | 1717404 |
| 1872077 | 826293 | 1857578 |
| 1872200 | 826414 | 1857700 |
| 2101528 | 1055743 | 2087001 |
| 2128551 | 1082763 | 2114048 |
| 2214142 | 1168357 | 2199642 |
| 2220054 | 1174270 | 2205555 |
| 2220178 | 1174392 | 2205678 |
| 2225310 | 1179524 | 2210809 |
| 2288436 | 1242651 | 2273936 |
| 2332892 | 1287109 | 2318392 |
| 2333140 | 1287355 | 2318640 |
| 2338338 | 1292598 | 2323838 |
| 2640799 | 1595014 | 2626299 |
| 2648129 | 1602344 | 2633629 |
| 2650867 | 1605081 | 2636366 |
| 2651006 | 1605221 | 2636506 |
| 2657651 | 1611869 | 2643153 |
| 2676311 | 1630524 | 2661809 |
| 2816109 | 1770324 | 2801609 |
| 2816370 | 1770584 | 2801870 |
| 2820224 | 1774439 | 2805724 |

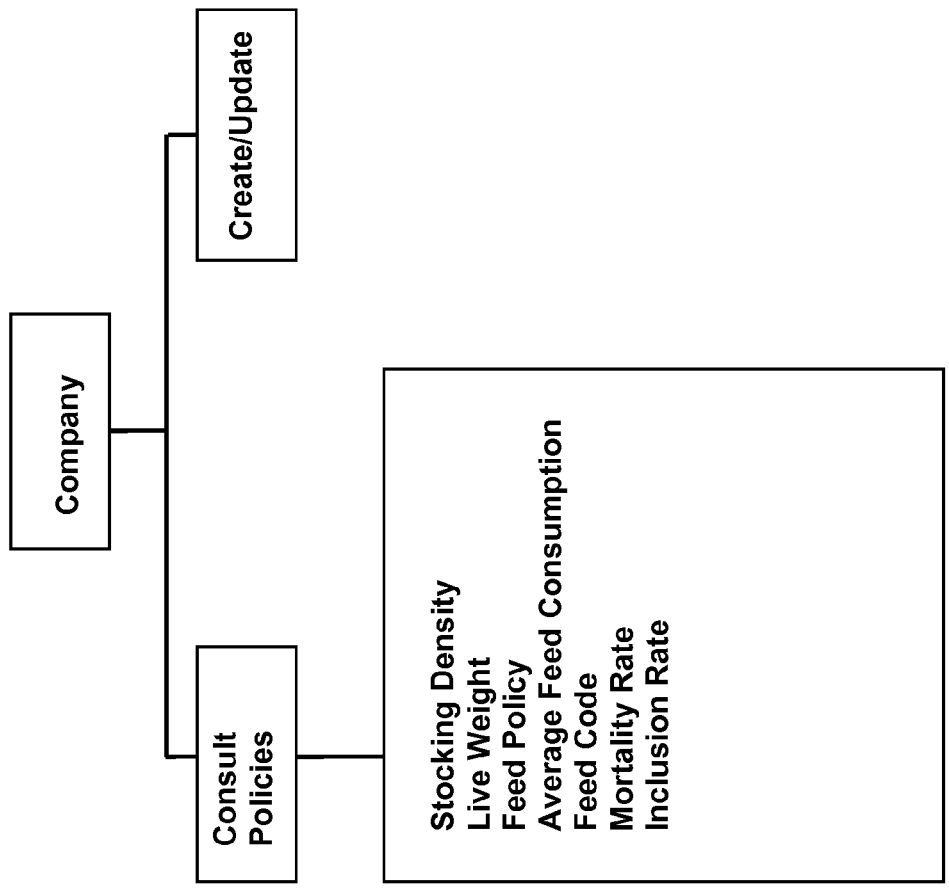

BREED-SPECIFIC HAPLOTYPES FOR POLLED PHENOTYPES IN CATTLE

INCORPORATION BY REFERENCE

This application claims benefit of the U.S. provisional patent application Ser. No. 61/015,521 filed on Dec. 20, 2007.

FEDERAL FUNDING LEGEND

This invention was made with government support under 2003-35205-12825 awarded by USDA/CSREES. Accordingly, the Federal Government has certain rights in this invention.

The foregoing applications, and all documents cited therein or during their prosecution ("appln cited documents") and all documents cited or references in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention.

FIELD OF THE INVENTION

The present invention relates to methods and systems of identification and management of beef cattle. More specifically, the invention relates to methods and systems relating to identification of single nucleotide polymorphisms (SNPs) and haplotypes associated with the polled phenotype. The invention further relates to methods and systems, including network-based processes, to manage the SNP data and other data relating to specific animals and herds of animals, veterinarian care, diagnostic and quality control data and management of livestock which, based on genotyping, have predictable meat quality traits, husbandry conditions, animal welfare, food safety information, audit of existing processes and data from field locations.

BACKGROUND OF THE INVENTION

Animals account for almost 20 percent of the world's food consumption, and animal-based food products are a major source of revenue throughout the world. In the United States alone, beef production is the fourth largest manufacturing industry and accounts for nearly 25 percent of the farm sector cash receipts and seven percent of supermarket sales each year.

Significant improvements in animal performance, efficiency and carcass and meat quality have been made over the years through the application of standard animal breeding and selection techniques. However, such classical animal breeding techniques require several years of genetic evaluation of performance records on individual animals and their relatives and are therefore very expensive. Other efforts have been made to improve productivity and quality through the application of such management practices as the use of feed additives, animal hormonal implants and chemotherapeutics. However, there is significant political and regulatory resistance to the introduction and use of such methodologies. Such methodologies are also non-heritable and need to be applied differently in every production system.

There is a need for methods that allow relatively easy and more efficient selection and breeding of farm animals that have an advantage for a heritable trait of the polled phenotype. The economic significance of the use of genetic markers that are associated with specific economically important traits in livestock through marker-assisted selection cannot therefore be over-emphasized.

The presence of horns within commercial cattle populations increases the chances of injuries, particularly during transportation. Quality defects in the form of bruised carcasses, arising from these injuries, cost the industry millions of dollars every year. Producers and packers ranked bruising as one of their top ten concerns for the fed steer and heifer industry in the National Beef Quality Audit-2000. Bruising was also the number two "quality challenge" of the market cow and bull beef industry. Dehorning cattle provides a recurrent managerial solution to the problem. However, there are negative stress effects to the animal, and concerns that dehorning may be an inhumane treatment.

The polled (hornless) condition in cattle has existed since domestication, and it has been selected by breeders because of its economic importance and ease of management. A single, dominant mutation is believed to cause the polled phenotype, but the causative gene remains unknown.

In 1991, Bricker and Church (Abst. 36th annual meeting of the Genetics Society of Canada [Kingston, Ontario. Jun. 11-14, 1991]) reviewed the co-segregaton of Poll with 1:29 translocation in Charolais cattle and found that Poll is very close to the centromere of chromosome 1. Georges et al., Nature Genetics 4: 206-210 (1993) localized the polled locus to the centromeric end of the bovine chromosome 1. This location was further refined by Brenneman et al., J. Heredity 87:156-161 (1996) to a region proximal to the centromere and 4.9 cM (centimorgan) from microsatellite TGLA49. Using the same population, the interval was further refined to a 1.7 megabase region between IFNAR and SOD1. Recently Drogemuller et al., Mammalian Genome 16: 613-620 (2005) localized the polled locus to a 1.0 megabase region between markers BM6438 and RP42-218J17_MS1 (FIG. 43).

Polymorphisms in candidate genes that show association with specific economically relevant traits (ERT) may be useful markers for marker-assisted selection. It remains advantageous to provide SNPs, so that a more accurate prediction can be made of the Polled phenotype of an animal, and also enable a business method that provides for increased productivity in livestock cattle, as well as providing access to various records of the animals and allows comparisons with expected or desired goals with regard to the quality and quantity of animals produced.

Citation or identification of any document in this application is not an admission that such document is available as prior art to the present invention.

SUMMARY OF THE INVENTION

The present invention relates to associations between SNPs and haplotypes of SNPs on bovine chromosome 1 with measures of the Polled phenotype in beef cattle.

The invention encompasses a method for breed-specific sub-grouping of animals according to genotype wherein the animals of each sub-group have similar polymorphisms in the Polled-associated gene(s) that may comprise determining the genotype of each animal to be sub-grouped by determining the presence of single nucleotide polymorphisms in or near the Polled-associated gene(s), and segregating individual animals into sub-groups wherein each animal in a sub-group has similar polymorphisms in the Polled-associated gene(s).

In particular, the invention encompasses a method for identifying an animal having the absence of horns as compared to the general population of animals of that species, comprising subjecting a specimen from the animal to nucleotide sequence analysis to obtain the nucleotide sequence of the animal and determining the presence of a single nucleotide polymorphism in a Polled gene of the animal by using a data storage system that compares the nucleotide sequence of the animal with bovine genotypes, wherein the single nucleotide polymorphism is indicative of the absence of horns.

The invention also encompasses a method for sub-grouping animals according to genotype wherein the animals of each sub-group have a similar genotype in the Polled-associated gene(s) that may comprise determining the genotype of each animal to be sub-grouped by determining the presence of single nucleotide polymorphism(s) of interest in or near the Polled-associated gene(s), and segregating individual animals into sub-groups depending on whether the animals have, or do not have, the single nucleotide polymorphism(s) of interest in or near the Polled-associated genes.

The single nucleotide polymorphism(s) located within the first 3 megabases of bovine chromosome 1 (SEQ ID 43, see FIG. 46, electronic file for sequence listing) may be selected from the group consisting of the following:

SNPs (Bovine Chromosome 1)
1. SNP A1356048G an A to G nucleotide substitution within the context of the following disclosed flanking sequences of: 5'-TATTTCCCTCTT-A/G-AAAAAA-GATAAA-3' (SEQ ID NO: 44).
2. SNP A1872077G an A to G nucleotide substitution within the context of the following disclosed flanking sequences of: 5'-CAAAGTTGTGTC-A/G-GCTTCT-GCTCTC-3' (SEQ ID NO: 45).
3. SNP T1872200C a T to C nucleotide substitution within the context of the following disclosed flanking sequences of: 5'-GGACAGTGGGTT-T/C-TCAT-CAGTTATC-3' (SEQ ID NO: 46).
4. SNP T2101528C a T to C nucleotide substitution within the context of the following disclosed flanking sequences of: 5'-TGTCTCTCTGCT-T/C-CTCTCTCTCCCC-3' (SEQ ID NO: 47).
5. SNP T2214142A a T to A nucleotide substitution within the context of the following disclosed flanking sequences of: 5'-CTTTCCAACTCA-T/A-GGGG-GAAGGATG-3' (SEQ ID NO: 48).
6. SNP T2220054C a T to C nucleotide substitution within the context of the following disclosed flanking sequences of: 5'-TCAACCTGGAGG-T/C-GGGGGTTTGGGG-3' (SEQ ID NO: 49).
7. SNP T2220178A a T to A nucleotide substitution within the context of the following disclosed flanking sequences of: 5'-CACCATTCCAAG-T/A-ACATAGG-TAGGC-3' (SEQ ID NO: 50).
8. SNP C2225310T a C to T nucleotide substitution within the context of the following disclosed flanking sequences of: 5'-AAGGTCTATCTT-C/T-AGGAA-GAGTTGC-3' (SEQ ID NO: 51).
9. SNP G2288436A a G to A nucleotide substitution within the context of the following disclosed flanking sequences of: 5'-TGAACACAGGAG-G/A-GT-GAACGTCTAA-3' (SEQ ID NO: 52).
10. SNP C2332892T a C to T nucleotide substitution within the context of the following disclosed flanking sequences of: 5'-TCTGGCGTTTCG-C/T-GGCCAA-GACACA-3' (SEQ ID NO: 53).
11. SNP G2333140A a G to A nucleotide substitution within the context of the following disclosed flanking sequences of: 5'-ACAAGGATAAAT-G/A-GCAAG-GAAGAAA-3' (SEQ ID NO: 54).
12. SNP C2338338T a C to T nucleotide substitution within the context of the following disclosed flanking sequences of: 5'-AGAGTATTCCAT-C/T-AGGAAAC-CTCAT-3' (SEQ ID NO: 55).
13. SNP T2816109G a T to G nucleotide substitution within the context of the following disclosed flanking sequences of: 5'-GCTTGCCTACAA-T/G-AGAAGA-CATCAG-3' (SEQ ID NO: 56).
14. SNP C2816370G a C to G nucleotide substitution within the context of the following disclosed flanking sequences of: 5'-AATCCCATGAGA-C/G-TGTTGC-CATCAG-3' (SEQ ID NO: 57).
15. SNP HP-1013610 a G to C nucleotide substitution within the context of the following disclosed flanking sequences of: 5'-TCATAAGAATTG-G/C-TACTAC-CTATAC-3' (SEQ ID NO: 58).
16. SNP HP-1352705 a T to A nucleotide substitution within the context of the following disclosed flanking sequences of: 5'-GATACAAACTGT-T/A-ATGTGT-GAGTAG-3' (SEQ ID NO: 59).
17. SNP HP-1352905 a C to G nucleotide substitution within the context of the following disclosed flanking sequences of: 5'-TGAGCATCACCC-C/G-CGG-GAGGGCTCT-3' (SEQ ID NO: 60).
18. SNP HP-1356048 a G to A nucleotide substitution within the context of the following disclosed flanking sequences of: 5'-TATTTCCCTCTT-G/A-AAAAAA-GATAAA-3' (SEQ ID NO: 61).
19. SNP HP-1431709 a G to A nucleotide substitution within the context of the following disclosed flanking sequences of: 5'-TTTTGCAAGGT-G/A-ATCTTGAG-TAAC-3' (SEQ ID NO: 62).
20. SNP HP-1438531 a T to C nucleotide substitution within the context of the following disclosed flanking sequences of: 5'-GAATCTTTTTCC-T/C-CAAATACTTTCT-3' (SEQ ID NO: 63).
21. SNP HP-1731905 a A to G nucleotide substitution within the context of the following disclosed flanking sequences of: 5'-GGAGGGGTATTC-A/G-AGGTGC-TATGAG-3' (SEQ ID NO: 64).
22. SNP HP-1872077 a A to G nucleotide substitution within the context of the following disclosed flanking sequences of: 5'-CAAAGTTGTGTC-A/G-GCTTCT-GCTCTC-3' (SEQ ID NO: 45).
23. SNP HP-1872200 a T to C nucleotide substitution within the context of the following disclosed flanking sequences of: 5'-GGACAGTGGGTT-T/C-TCAT-CAGTTATC-3' (SEQ ID NO: 46).
24. SNP HP-2101528 a C to T nucleotide substitution within the context of the following disclosed flanking sequences of: 5'-CTGTCTCTCTGCT-C/T-CTCTCTCTCCCC-3' (SEQ ID NO: 65).
25. SNP HP-2128551 a T to C nucleotide substitution within the context of the following disclosed flanking sequences of: 5'-TCTCCACTGACT-T/C-CCCCCCTTTCTA-3' (SEQ ID NO: 66).
26. SNP HP-2214142 a A to T nucleotide substitution within the context of the following disclosed flanking sequences of: 5'-CTTTCCAACTCA-A/T-GGGG-GAAGGATG-3' (SEQ ID NO: 67).
27. SNP HP-2220054 a C to T nucleotide substitution within the context of the following disclosed flanking sequences of: 5'-TCAACCTGGAGG-C/T-GGGGGTTTGGGG-3' (SEQ ID NO: 68).
28. SNP HP-2220178 a A to T nucleotide substitution within the context of the following disclosed flanking sequences of: 5'-CACCATTCCAAG-A/T-ACATAGG-TAGGC-3' (SEQ ID NO: 69).
29. SNP HP-2225310 a T to C nucleotide substitution within the context of the following disclosed flanking sequences of: 5'-AAGGTCTATCTT-T/C-AGGAA-GAGTTGC-3' (SEQ ID NO: 70).
30. SNP HP-2288436 a G to A nucleotide substitution within the context of the following disclosed flanking sequences of: 5'-TGAACACAGGAG-G/A-GT-GAACGTCTAA-3' (SEQ ID NO: 52).
31. SNP HP-2332892 a C to T nucleotide substitution within the context of the following disclosed flanking sequences of: 5'-TCTGGCGTTTCG-C/T-GGCCAA-GACACA-3' (SEQ ID NO: 53).
32. SNP HP-2333140 a A to G nucleotide substitution within the context of the following disclosed flanking sequences of: 5'-ACAAGGATAAAT-A/G-GCAAG-GAAGAAA-3' (SEQ ID NO: 71).
33. SNP HP-2338338 a T to C nucleotide substitution within the context of the following disclosed flanking sequences of: 5'-AGAGTATTCCAT-T/C-AGGAAAC-CTCAT-3' (SEQ ID NO: 72).
34. SNP HP-2640799 a T to A nucleotide substitution within the context of the following disclosed flanking sequences of: 5'-CTTTTTCAGAGT-T/A-TGATTAC-CCAGA-3' (SEQ ID NO: 73).
35. SNP HP-2648129 a T to C nucleotide substitution within the context of the following disclosed flanking sequences of: 5'-CTAATAGTTCTT-T/C-ACAGT-GAGCTGA-3' (SEQ ID NO: 74).
36. SNP HP-2650867 a T to A nucleotide substitution within the context of the following disclosed flanking sequences of: 5'-TTTAAACAGTGC-T/A-GGATAT-GCTTTG-3' (SEQ ID NO: 75).
37. SNP HP-2651006 a G to T nucleotide substitution within the context of the following disclosed flanking sequences of: 5'-TCCCCATTCTGA-G/T-CCCCTTTCACCC-3' (SEQ ID NO: 76).
38. SNP HP-2657651 a G to C nucleotide substitution within the context of the following disclosed flanking sequences of: 5'-TGGTTAAACCAC-G/C-CCT-TCGGGTTAT-3' (SEQ ID NO: 77).
39. SNP HP-2676311 a T to C nucleotide substitution within the context of the following disclosed flanking sequences of: 5'-CTCTTGCTCTTC-T/C-CATACAC-CGCAA-3' (SEQ ID NO: 78).
40. SNP HP-2816109 a T to G nucleotide substitution within the context of the following disclosed flanking sequences of: 5'-GCTTGCCTACAA-T/G-AGAAGA-CATCAG-3' (SEQ ID NO: 56).
41. SNP HP-2816370 a C to G nucleotide substitution within the context of the following disclosed flanking sequences of: 5'-AATCCCATGAGA-C/G-TGTTGC-CATCAG-3' (SEQ ID NO: 57).
42. SNP HP-2820224 a T to G nucleotide substitution within the context of the following disclosed flanking sequences of: 5'-GCCAATTTTTC-T/G-CAAGTC-CAACAA-3' (SEQ ID NO: 79).

The invention further relates to a method for sub-grouping animals according to genotype wherein the animals of each sub-group have similar haplotypes in the Polled-associated gene(s) that may comprise determining the genotype of each animal to be sub-grouped by determining the presence of any of the above SNPs, and segregating individual animals into sub-groups depending on whether the animals have, or do not have, any of the above SNPs in or near the Polled-associated genes.

The invention also relates to a method for identifying an animal having a desirable phenotype as compared to the general population of animals of that species, which may comprise determining the presence of single nucleotide polymorphisms in or near the Polled-associated genes of the animal, wherein the presence of the SNPs are indicative of a desirable phenotype.

In an advantageous embodiment, the animal may be a bovine. In another advantageous embodiment, the Polled-associated genes may be bovine Polled-associated genes.

The invention also encompasses computer-assisted methods and systems for improving the production efficiency for livestock using multiple data, and in particular the genotype of the animals as it relates to Polled-associated SNPs. Methods of the invention encompass obtaining a genetic sample from each animal in a herd of livestock, determining the genotype of each animal with respect to specific quality traits as defined by a panel of at least two single nucleotide polymorphisms (SNPs), grouping animals with like genotypes, and optionally, further sub-grouping animals based on like phenotypes and haplotypes. Methods of the invention may also encompass obtaining and maintaining data relating to the animals or to herds, their husbandry conditions, health and veterinary care and condition, genetic history or parentage, and providing those data to others through systems that are web-based, contained in a database, or attached to the animal itself such as by an implanted microchip. An advantageous aspect of the present invention, therefore, is directed to a computer system and computer-assisted methods for tracking quality traits for livestock possessing specific genetic predispositions.

The present invention advantageously encompasses computer-assisted methods and systems for acquiring genetic data, particularly genetic data as defined by the absence or presence of a SNP within or near the Polled-associated genes related to production and associating those data with other data about the animal or its herd, and maintaining those data in ways that are accessible. Another aspect of the invention encompasses a computer-assisted method for predicting which livestock animals possess a biological difference in Polled, and which may include the steps of using a computer system, e.g., a programmed computer comprising a processor, a data storage system, an input device and an output device, the steps of: (a) inputting into the programmed computer through the input device data that include a genotype of an animal as it relates to any one of the Polled-associated SNPs described herein, (b) correlating production efficiency or carcass merit predicted by the Polled-associated genotypes using the processor and the data storage system and (c) outputting to the output device the predicted production efficiency or carcass merit correlated to the Polled-associated genotypes, thereby predicting which livestock animals possess desirable characteristics for animal handling and carcass merit, including freedom from bruising.

Yet another aspect of the invention relates to a method of doing business for managing livestock comprising providing to a user a computer system for managing livestock comprising physical characteristics and genotypes corresponding to one or more animals or a computer readable media for managing livestock comprising physical characteristics and genotypes corresponding to one or more animals or physical characteristics and genotypes corresponding to one or more animals, wherein such physical characteristics as increased potential for carcass merit due to freedom from bruising are associated with the Polled genotype and haplotypes.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The following detailed description, given by way of examples, but not intended to limit the invention solely to the specific embodiments described, may best be understood in conjunction with the accompanying drawings, in which:

FIG. 1 depicts 500 bp of nucleic acid sequence (250 bp on either side) of SNP A1356048G (SEQ ID NO: 1) in build Btau3.0 of the bovine genome sequence.

FIG. 2 depicts 500 bp of nucleic acid sequence (250 bp on either side) of SNP A1872077G (SEQ ID NO: 2) in build Btau3.0 of the bovine genome sequence.

FIG. 3 depicts 500 bp of nucleic acid sequence (250 bp on either side) of SNP T1872200C (SEQ ID NO: 3) in build Btau3.0 of the bovine genome sequence.

FIG. 4 depicts 500 bp of nucleic acid sequence (250 bp on either side) of SNP T2101528C (SEQ ID NO: 4) in build Btau3.0 of the bovine genome sequence.

FIG. 5 depicts 500 bp of nucleic acid sequence (250 bp on either side) of SNP T2214142A (SEQ ID NO: 5) in build Btau3.0 of the bovine genome sequence.

FIG. 6 depicts 500 bp of nucleic acid sequence (250 bp on either side) of SNP T2220054C (SEQ ID NO: 6) in build Btau3.0 of the bovine genome sequence.

FIG. 7 depicts 500 bp of nucleic acid sequence (250 bp on either side) of SNP T2220178A (SEQ ID NO: 7) in build Btau3.0 of the bovine genome sequence.

FIG. 8 depicts 500 bp of nucleic acid sequence (250 bp on either side) of SNP C2225310T (SEQ ID NO: 8) in build Btau3.0 of the bovine genome sequence.

FIG. 9 depicts 500 bp of nucleic acid sequence (250 bp on either side) of SNP G2288436A (SEQ ID NO: 9) in build Btau3.0 of the bovine genome sequence.

FIG. 10 depicts 500 bp of nucleic acid sequence (250 bp on either side) of SNP C2332892T (SEQ ID NO: 10) in build Btau3.0 of the bovine genome sequence.

FIG. 11 depicts 500 bp of nucleic acid sequence (250 bp on either side) of SNP G2333140A (SEQ ID NO: 1) in build Btau3.0 of the bovine genome sequence.

FIG. 12 depicts 500 bp of nucleic acid sequence (250 bp on either side) of SNP C2338338T (SEQ ID NO: 12) in build Btau3.0 of the bovine genome sequence.

FIG. 13 depicts 500 bp of nucleic acid sequence (250 bp on either side) of SNP T2816109G (SEQ ID NO: 13) in build Btau3.0 of the bovine genome sequence.

FIG. 14 depicts 500 bp of nucleic acid sequence (250 bp on either side) of SNP C2816370G (SEQ ID NO: 14) in build Btau3.0 of the bovine genome sequence.

FIG. 15 depicts 500 bp of nucleic acid sequence (250 bp on either side) of SNP HP-1013610 (SEQ ID NO: 15) in build Btau3.0 of the bovine genome sequence.

FIG. 16 depicts 500 bp of nucleic acid sequence (250 bp on either side) of SNP HP-1352705 (SEQ ID NO: 16) in build Btau3.0 of the bovine genome sequence.

FIG. 17 depicts 500 bp of nucleic acid sequence (250 bp on either side) of SNP HP-1352905 (SEQ ID NO: 17) in build Btau3.0 of the bovine genome sequence.

FIG. 18 depicts 500 bp of nucleic acid sequence (250 bp on either side) of SNP HP-1356048 (SEQ ID NO: 18) in build Btau3.0 of the bovine genome sequence.

FIG. 19 depicts 500 bp of nucleic acid sequence (250 bp on either side) of SNP HP-1431709 (SEQ ID NO: 19) in build Btau3.0 of the bovine genome sequence.

FIG. 20 depicts 500 bp of nucleic acid sequence (250 bp on either side) of SNP HP-1438531 (SEQ ID NO: 20) in build Btau3.0 of the bovine genome sequence.

FIG. 21 depicts 500 bp of nucleic acid sequence (250 bp on either side) of SNP HP-1731905 (SEQ ID NO: 21) in build Btau3.0 of the bovine genome sequence.

FIG. 22 depicts 500 bp of nucleic acid sequence (250 bp on either side) of SNP HP-1872077 (SEQ ID NO: 22) in build Btau3.0 of the bovine genome sequence.

FIG. 23 depicts 500 bp of nucleic acid sequence (250 bp on either side) of SNP HP-1872200 (SEQ ID NO: 23) in build Btau3.0 of the bovine genome sequence.

FIG. 24 depicts 500 bp of nucleic acid sequence (250 bp on either side) of SNP HP-2101528 (SEQ ID NO: 24) in build Btau3.0 of the bovine genome sequence.

FIG. 25 depicts 500 bp of nucleic acid sequence (250 bp on either side) of SNP HP-2128551 (SEQ ID NO: 25) in build Btau3.0 of the bovine genome sequence.

FIG. 26 depicts 500 bp of nucleic acid sequence (250 bp on either side) of SNP HP-2214142 (SEQ ID NO: 26) in build Btau3.0 of the bovine genome sequence.

FIG. 27 depicts 500 bp of nucleic acid sequence (250 bp on either side) of SNP HP-2220054 (SEQ ID NO: 27) in build Btau3.0 of the bovine genome sequence.

FIG. 28 depicts 500 bp of nucleic acid sequence (250 bp on either side) of SNP HP-2220178 (SEQ ID NO: 28) in build Btau3.0 of the bovine genome sequence.

FIG. 29 depicts 500 bp of nucleic acid sequence (250 bp on either side) of SNP HP-2225310 (SEQ ID NO: 29) in build Btau3.0 of the bovine genome sequence.

FIG. 30 depicts 500 bp of nucleic acid sequence (250 bp on either side) of SNP HP-2288436 (SEQ ID NO: 30) in build Btau3.0 of the bovine genome sequence.

FIG. 31 depicts 500 bp of nucleic acid sequence (250 bp on either side) of SNP HP-2332892 (SEQ ID NO: 31) in build Btau3.0 of the bovine genome sequence.

FIG. 32 depicts 500 bp of nucleic acid sequence (250 bp on either side) of SNP HP-2333140 (SEQ ID NO: 32) in build Btau3.0 of the bovine genome sequence.

FIG. 33 depicts 500 bp of nucleic acid sequence (250 bp on either side) of SNP HP-2338338 (SEQ ID NO: 33) in build Btau3.0 of the bovine genome sequence.

FIG. 34 depicts 500 bp of nucleic acid sequence (250 bp on either side) of SNP HP-2640799 (SEQ ID NO: 34) in build Btau3.0 of the bovine genome sequence.

FIG. 35 depicts 500 bp of nucleic acid sequence (250 bp on either side) of SNP HP-2648129 (SEQ ID NO: 35) in build Btau3.0 of the bovine genome sequence.

FIG. 36 depicts 500 bp of nucleic acid sequence (250 bp on either side) of SNP HP-2650867 (SEQ ID NO: 36) in build Btau3.0 of the bovine genome sequence.

FIG. 37 depicts 500 bp of nucleic acid sequence (250 bp on either side) of SNP HP-2651006 (SEQ ID NO: 37) in build Btau3.0 of the bovine genome sequence.

FIG. 38 depicts 500 bp of nucleic acid sequence (250 bp on either side) of SNP HP-2657651 (SEQ ID NO: 38) in build Btau3.0 of the bovine genome sequence.

FIG. 39 depicts 500 bp of nucleic acid sequence (250 bp on either side) of SNP HP-2676311 (SEQ ID NO: 39) in build Btau3.0 of the bovine genome sequence.

FIG. 40 depicts 500 bp of nucleic acid sequence (250 bp on either side) of SNP HP-2816109 (SEQ ID NO: 40) in build Btau3.0 of the bovine genome sequence.

FIG. 41 depicts 500 bp of nucleic acid sequence (250 bp on either side) of SNP HP-2816370 (SEQ ID NO: 41) in build Btau3.0 of the bovine genome sequence.

FIG. 42 depicts 500 bp of nucleic acid sequence (250 bp on either side) of SNP HP-2820224 (SEQ ID NO: 42) in build Btau3.0 of the bovine genome sequence.

FIG. 43 illustrates a genetic linkage map for Poll on Bovine chromosome 1.

FIG. 44 lists species-specific bovine Polled minor allele frequencies.

FIG. 45 depicts the mode of Poll Inheritance as defined by Long and Gregory, J. Heredity 69: 395-400 (1978). In this illustration, the predicted phenotypes of Horned (hollow, bony growths that are fused to the skull), Scurred (loose "cartilaginous" growths), and Polled (no growth) inheritance are shown relative to genotypes.

FIG. 46 depicts the first 3 Mb (bases 1 thru 3,000,000) of the Sequence of Bos taurus Chromosome 1 build Btau3.0 (SEQ ID NO. 43). See electronic compact disk sequence listing. File name: Btaurus Chm 1 seq.txt.

FIG. 47 presents a comparison of horn/poll marker coordinates in successive releases of the bovine genome sequence.

FIG. 50C illustrates the flow of events through the subroutines related to data entry concerning data specific to a company.

DETAILED DESCRIPTION

Figure 48:
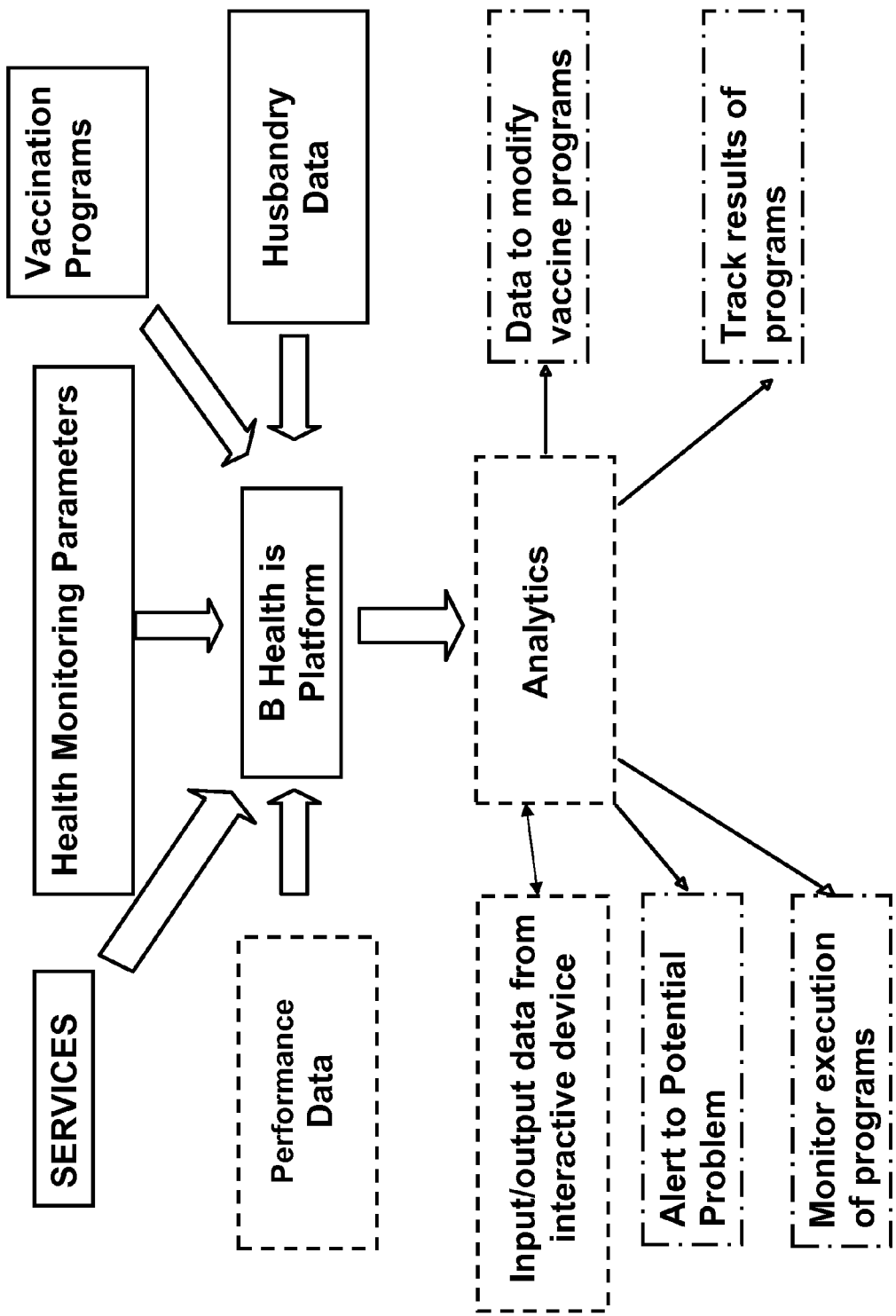
FIG. 48 illustrates a flowchart of the input of data and the output of results from the analysis and correlation of the data pertaining to the breeding, veterinarian histories and performance requirements of a group of animals such as from a herd of cows and the interactive flow of data from the computer-assisted device to a body of students learning the use of the method of the invention.

The practice of the present invention will employ, unless otherwise indicated, conventional techniques of molecular biology, microbiology, recombinant DNA technology, and immunology, which are within the skill of the art. Such techniques are explained fully in the literature. See, e.g., Sambrook et al. (2001) Molecular Cloning: A Laboratory Manual, 3rd ed., Cold Spring Harbor Press; DNA Cloning, Vols. I and II (D. N. Glover ed. 1985); Oligonucleotide Synthesis (M. J. Gait ed. 1984); Nucleic Acid Hybridization (B. D. Hames & S. J. Higgins eds. 1984); Animal Cell Culture (R. K. Freshney ed. 1986); Immobilized Cells and Enzymes (IRL press, 1986); Perbal, B., A Practical Guide to Molecular Cloning (1984); the series, Methods In Enzymology (S. Colowick and N. Kaplan eds., Academic Press, Inc.); and Handbook of Experimental Immunology, Vols. I-IV (D. M. Weir and C. C. Blackwell eds., 1986, Blackwell Scientific Publications).

Before describing the present invention in detail, it is to be understood that this invention is not limited to particular DNA, polypeptide sequences or process parameters as such may, of course, vary. It is also to be understood that the terminology used herein is for the purpose of describing particular embodiments of the invention only, and is not intended to be limiting.

Unless defined otherwise, all technical and scientific terms used herein have the same meaning as commonly understood by one of ordinary skill in the art to which the invention pertains. Although a number of methods and materials similar or equivalent to those described herein can be used in the practice of the present invention, the preferred materials and methods are described herein.

In describing the present invention, the following terms will be employed and are intended to be defined as indicated below.

The term "cow" or "cattle" is used generally to refer to an animal of bovine origin of any age. Interchangeable terms include "bovine", "calf", "steer", "bull", "heifer" and the like. It also includes an individual animal in all stages of development, including embryonic and fetal stages. The animals as referred to herein may also include individuals or groups of individuals that are raised for other than food production such as, but not limited to, transgenic animals for the production of biopharmaceuticals including antibodies and other proteins or protein products.

By the term "complementarity" or "complementary" is meant, for the purposes of the specification or claims, a sufficient number in the oligonucleotide of complementary base pairs in its sequence to interact specifically (hybridize) with a target nucleic acid sequence of the gene polymorphism to be amplified or detected. As known to those skilled in the art, a very high degree of complementarity is needed for specificity and sensitivity involving hybridization, although it need not be 100%. Thus, for example, an oligonucleotide that is identical in nucleotide sequence to an oligonucleotide disclosed herein, except for one base change or substitution, may function equivalently to the disclosed oligonucleotides. A "complementary DNA" or "cDNA" gene includes recombinant genes synthesized by reverse transcription of messenger RNA ("mRNA").

A "cyclic polymerase-mediated reaction" refers to a biochemical reaction in which a template molecule or a population of template molecules is periodically and repeatedly copied to create a complementary template molecule or complementary template molecules, thereby increasing the number of the template molecules over time.

By the term "detectable moiety" is meant, for the purposes of the specification or claims, a label molecule (isotopic or non-isotopic) which is incorporated indirectly or directly into an oligonucleotide, wherein the label molecule facilitates the detection of the oligonucleotide in which it is incorporated, for example when the oligonucleotide is hybridized to amplified gene polymorphic sequences. Thus, "detectable moiety" is used synonymously with "label molecule". Synthesis of oligonucleotides can be accomplished by any one of several methods known to those skilled in the art. Label molecules, known to those skilled in the art as being useful for detection, include chemiluminescent, fluorescent or luminescent molecules. Various fluorescent molecules are known in the art which are suitable for use to label a nucleic acid for the method of the present invention. The protocol for such incorporation may vary depending upon the fluorescent molecule used. Such protocols are known in the art for the respective fluorescent molecule.

"DNA amplification" as used herein refers to any process that increases the number of copies of a specific DNA sequence by enzymatically amplifying the nucleic acid sequence. A variety of processes are known. One of the most commonly used is the polymerase chain reaction (PCR) process of Mullis as described in U.S. Pat. Nos. 4,683,195 and 4,683,202. Methods, devices and reagents as described in U.S. Pat. Nos. 6,951,726; 6,927,024; 6,924,127; 6,893,863; 6,887,664; 6,881,559; 6,855,522; 6,855,521; 6,849,430; 6,849,404; 6,846,631; 6,844,158; 6,844,155; 6,818,437; 6,818,402; 6,794,177; 6,794,133; 6,790,952; 6,783,940; 6,773,901; 6,770,440; 6,767,724; 6,750,022; 6,744,789; 6,733,999; 6,733,972; 6,703,236; 6,699,713; 6,696,277; 6,664,080; 6,664,064; 6,664,044; RE38,352; 6,650,719; 6,645,758; 6,645,720; 6,642,000; 6,638,716; 6,632,653; 6,617,107; 6,613,560; 6,610,487; 6,596,492; 6,586,250; 6,586,233; 6,569,678; 6,569,627; 6,566,103; 6,566,067; 6,566,052; 6,558,929; 6,558,909; 6,551,783; 6,544,782; 6,537,752; 6,524,830; 6,518,020; 6,514,750; 6,514,706; 6,503,750; 6,503,705; 6,493,640; 6,492,114; 6,485,907; 6,485,903; 6,482,588; 6,475,729; 6,468,743; 6,465,638; 6,465,637; 6,465,171; 6,448,014; 6,432,646; 6,428,987; 6,426,215; 6,423,499; 6,410,223; 6,403,341; 6,399,320; 6,395,518; 6,391,559; 6,383,755; 6,379,932; 6,372,484; 6,368,834; 6,365,375; 6,358,680; 6,355,422; 6,348,336; 6,346,384; 6,319,673; 6,316,195; 6,316,192; 6,312,930; 6,309,840; 6,309,837; 6,303,343; 6,300,073; 6,300,072; 6,287,781; 6,284,455; 6,277,605; 6,270,977; 6,270,966; 6,268,153; 6,268,143; D445,907; 6,261,431; 6,258,570; 6,258,567; 6,258,537; 6,258,529; 6,251,607; 6,248,567; 6,235,468; 6,232,079; 6,225,093; 6,221,595; D441,091; 6,218,153; 6,207,425; 6,183,999; 6,183,963; 6,180,372; 6,180,349; 6,174,670; 6,153,412; 6,146,834; 6,143,496; 6,140,613; 6,140,110; 6,103,468; 6,087,097; 6,072,369; 6,068,974; 6,063,563; 6,048,688; 6,046,039; 6,037,129; 6,033,854; 6,031,960; 6,017,699; 6,015,664; 6,015,534; 6,004,747; 6,001,612; 6,001,572; 5,985,619; 5,976,842; 5,972,602; 5,968,730; 5,958,686; 5,955,274; 5,952,200; 5,936,968; 5,909,468; 5,905,732; 5,888,740; 5,883,924; 5,876,978; 5,876,977; 5,874,221; 5,869,318; 5,863,772; 5,863,731; 5,861,251; 5,861,245; 5,858,725; 5,858,718; 5,856,086; 5,853,991; 5,849,497; 5,837,468; 5,830,663; 5,827,695; 5,827,661; 5,827,657; 5,824,516; 5,824,479; 5,817,797; 5,814,489; 5,814,453; 5,811,296; 5,804,383; 5,800,997; 5,780,271; 5,780,222; 5,776,686; 5,774,497; 5,766,889; 5,759,822; 5,750,347; 5,747,251; 5,741,656; 5,716,784; 5,712,125; 5,712,090; 5,710,381; 5,705,627; 5,702,884; 5,693,467; 5,691,146; 5,681,741; 5,674,717; 5,665,572; 5,665,539; 5,656,493; 5,656,461; 5,654,144; 5,652,102; 5,650,268; 5,643,765; 5,639,871; 5,639,611; 5,639,606; 5,631,128; 5,629,178; 5,627,054; 5,618,703; 5,618,702; 5,614,388; 5,610,017; 5,602,756; 5,599,674; 5,589,333; 5,585,238; 5,576,197; 5,565,340; 5,565,339; 5,556,774; 5,556,773; 5,538,871; 5,527,898; 5,527,510; 5,514,568; 5,512,463; 5,512,462; 5,501,947; 5,494,795; 5,491,225; 5,487,993; 5,487,985; 5,484,699; 5,476,774; 5,475,610; 5,447,839; 5,437,975; 5,436,144; 5,426,026; 5,420,009; 5,411,876; 5,393,657; 5,389,512; 5,364,790; 5,364,758; 5,340,728; 5,283,171; 5,279,952; 5,254,469; 5,241,363; 5,232,829; 5,231,015; 5,229,297; 5,224,778; 5,219,727; 5,213,961; 5,198,337; 5,187,060; 5,142,033; 5,091,310; 5,082,780; 5,066,584; 5,023,171 and 5,008,182 may also be employed in the practice of the present invention. PCR involves the use of a thermostable DNA polymerase, known sequences as primers, and heating cycles, which separate the replicating deoxyribonucleic acid (DNA), strands and exponentially amplify a gene of interest. Any type of PCR, such as quantitative PCR, RT-PCR, hot start PCR, LAPCR, multiplex PCR, touchdown PCR, real-time PCR, etc., may be used. In general, the PCR amplification process involves a cyclic enzymatic chain reaction for preparing exponential quantities of a specific nucleic acid sequence. It requires a small amount of a sequence to initiate the chain reaction and oligonucleotide primers that will hybridize to the sequence. In PCR the primers are annealed to denatured nucleic acid followed by extension with an inducing agent (enzyme) and nucleotides. This results in newly synthesized extension products. Since these newly synthesized sequences become templates for the primers, repeated cycles of denaturing, primer annealing, and extension results in exponential accumulation of the specific sequence being amplified. The extension product of the chain reaction will be a discrete nucleic acid duplex with a termini corresponding to the ends of the specific primers employed.

By the terms "enzymatically amplify" or "amplify" is meant, for the purposes of the specification or claims, DNA amplification, i.e., a process by which nucleic acid sequences are amplified in number. There are several means for enzymatically amplifying nucleic acid sequences. Currently the most commonly used method is the polymerase chain reaction (PCR). Other amplification methods include LCR (ligase chain reaction) which utilizes DNA ligase, and a probe consisting of two halves of a DNA segment that is complementary to the sequence of the DNA to be amplified, enzyme QB replicase and a ribonucleic acid (RNA) sequence template attached to a probe complementary to the DNA to be copied which is used to make a DNA template for exponential production of complementary RNA; strand displacement amplification (SDA); Qβ replicase amplification (QβRA); self-sustained replication (3 SR); and NASBA (nucleic acid sequence-based amplification), which can be performed on RNA or DNA as the nucleic acid sequence to be amplified.

A "fragment" of a molecule such as a protein or nucleic acid is meant to refer to any portion of the amino acid or nucleotide genetic sequence.

As used herein, the term "genome" refers to all the genetic material in the chromosomes of a particular organism. Its size is generally given as its total number of base pairs. Within the genome, the term "gene" refers to a locatable region of genomic sequence, corresponding to a unit of inheritance, which is associated with regulatory regions, transcribed regions and/or other functional sequence regions. The physical development and phenotype of organisms can be thought of as a product of genes interacting with each other and with the environment. A concise definition of "gene" taking into account complex patterns of regulation and transcription, genic conservation and non-coding RNA genes, has been proposed by Gerstein et al. (Genome Research 17 (6), 669-681, 2007) "A gene is a union of genomic sequences encoding a coherent set of potentially overlapping functional products". In general, an animal's genetic characteristics, as defined by the nucleotide sequence of its genome, are known as its "genotype," while the animal's physical traits are described as its "phenotype."

By "heterozygous" or "heterozygous polymorphism" is meant that the two alleles of a diploid cell or organism at a given locus are different, that is, that they have a different nucleotide exchanged for the same nucleotide at the same place in their sequences.

By "homozygous" or "homozygous polymorphism" is meant that the two alleles of a diploid cell or organism at a given locus are identical, that is, that they have the same nucleotide for nucleotide exchange at the same place in their sequences.

By "hybridization" or "hybridizing," as used herein, is meant the formation of A-T and C-G base pairs between the nucleotide sequence of a fragment of a segment of a polynucleotide and a complementary nucleotide sequence of an oligonucleotide. By complementary is meant that at the locus of each A, C, G or T (or U in a ribonucleotide) in the fragment sequence, the oligonucleotide sequenced has a T, G, C or A, respectively. The hybridized fragment/oligonucleotide is called a "duplex."

A "hybridization complex", such as in a sandwich assay, means a complex of nucleic acid molecules including at least the target nucleic acid and a sensor probe. It may also include an anchor probe.

As used herein, the term "locus" or "loci" refers to the site of a gene on a chromosome. Pairs of genes, known as "alleles" control the hereditary trait produced by a gene locus. Each animal's particular combination of alleles is referred to as its "genotype". Where both alleles are identical the individual is said to be homozygous for the trait controlled by that gene pair; where the alleles are different, the individual is said to be heterozygous for the trait.

A "melting temperature" is meant the temperature at which hybridized duplexes dehybridize and return to their single-stranded state. Likewise, hybridization will not occur in the first place between two oligonucleotides, or, herein, an oligonucleotide and a fragment, at temperatures above the melting temperature of the resulting duplex. It is presently advantageous that the difference in melting point temperatures of oligonucleotide-fragment duplexes of this invention be from about 1° C. to about 10° C. so as to be readily detectable.

As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule can be single-stranded or double-stranded, but advantageously is double-stranded DNA. "DNA" refers to the polymeric form of deoxyribonucleotides (adenine, guanine, thymine, or cytosine) in its either single stranded form, or a double-stranded helix. This term refers only to the primary and secondary structure of the molecule, and does not limit it to any particular tertiary forms. Thus, this term includes double-stranded DNA found, inter alia, in linear DNA molecules (e.g., restriction fragments), viruses, plasmids, and chromosomes. In discussing the structure of particular double-stranded DNA molecules, sequences may be described herein according to the normal convention of giving only the sequence in the 5' to 3' direction along the nontranscribed strand of DNA (i.e., the strand having a sequence homologous to the mRNA). An "isolated" nucleic acid molecule is one that is separated from other nucleic acid molecules that are present in the natural source of the nucleic acid.

A "nucleoside" refers to a base linked to a sugar. The base may be adenine (A), guanine (G) (or its substitute, inosine (I)), cytosine (C), or thymine (T) (or its substitute, uracil (U)). The sugar may be ribose (the sugar of a natural nucleotide in RNA) or 2-deoxyribose (the sugar of a natural nucleotide in DNA). A "nucleotide" refers to a nucleoside linked to a single phosphate group.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides may be chemically synthesized and may be used as primers or probes. Oligonucleotide means any nucleotide of more than 3 bases in length used to facilitate detection or identification of a target nucleic acid, including probes and primers.

A "polymerase" is an enzyme that catalyzes the sequential addition of monomeric units to a polymeric chain, or links two or more monomeric units to initiate a polymeric chain. The "polymerase" will work by adding monomeric units whose identity is determined by and which is complementary to a template molecule of a specific sequence. For example, DNA polymerases such as DNA pol 1 and Taq polymerase add deoxyribonucleotides to the 3' end of a polynucleotide chain in a template-dependent manner, thereby synthesizing a nucleic acid that is complementary to the template molecule. Polymerases may be used either to extend a primer once or repetitively or to amplify a polynucleotide by repetitive priming of two complementary strands using two primers. A "thermostable polymerase" refers to a DNA or RNA polymerase enzyme that can withstand extremely high temperatures, such as those approaching 100° C. Often, thermostable polymerases are derived from organisms that live in extreme temperatures, such as *Thermus aquaticus*. Examples of thermostable polymerases include Taq, Tth, Pfu, Vent, deep vent, UlTma, and variations and derivatives thereof.

A "polynucleotide" refers to a linear chain of nucleotides connected by a phosphodiester linkage between the 3'-hydroxyl group of one nucleoside and the 5'-hydroxyl group of a second nucleoside which in turn is linked through its 3'-hydroxyl group to the 5'-hydroxyl group of a third nucleoside and so on to form a polymer comprised of nucleosides linked by a phosphodiester backbone. A "modified polynucleotide" refers to a polynucleotide in which one or more natural nucleotides have been partially, substantially, or completely replaced with modified nucleotides.

A "primer" is an oligonucleotide, the sequence of at least of portion of which is complementary to a segment of a template DNA which is to be amplified or replicated. Typically primers are used in performing the polymerase chain reaction (PCR). A primer hybridizes with (or "anneals" to) the template DNA and is used by the polymerase enzyme as the starting point for the replication/amplification process. The primers herein are selected to be "substantially" complementary to different strands of a particular target DNA sequence. This means that the primers must be sufficiently complementary to hybridize with their respective strands. Therefore, the primer sequence need not reflect the exact sequence of the template. For example, a non-complementary nucleotide fragment may be attached to the 5' end of the primer, with the remainder of the primer sequence being complementary to the strand. Alternatively, non-complementary bases or longer sequences can be interspersed into the primer, provided that the primer sequence has sufficient complementarity with the sequence of the strand to hybridize therewith and thereby form the template for the synthesis of the extension product.

"Probes" refer to oligonucleotides nucleic acid sequences of variable length, used in the detection of identical, similar, or complementary nucleic acid sequences by hybridization. An oligonucleotide sequence used as a detection probe may be labeled with a detectable moiety.

The following are non-limiting examples of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes and primers. A polynucleotide may comprise modified nucleotides, such as methylated nucleotides and nucleotide analogs, uracil, other sugars and linking groups such as fluororibose and thiolate, and nucleotide branches. The sequence of nucleotides may be further modified after polymerization, such as by conjugation, with a labeling component. Other types of modifications included in this definition are caps, substitution of one or more of the naturally occurring nucleotides with an analog, and introduction of means for attaching the polynucleotide to proteins, metal ions, labeling components, other polynucleotides or solid support.

An "isolated" polynucleotide or polypeptide is one that is substantially pure of the materials with which it is associated in its native environment. By substantially free, is meant at least 50%, at least 55%, at least 60%, at least 65%, at advantageously at least 70%, at least 75%, more advantageously at least 80%, at least 85%, even more advantageously at least 90%, at least 91%, at least 92%, at least 93%, at least 94%, at least 95%, at least 96%, at least 97%, most advantageously at least 98%, at least 99%, at least 99.5%, at least 99.9% free of these materials.

An "isolated" nucleic acid molecule is a nucleic acid molecule separate and discrete from the whole organism with which the molecule is found in nature; or a nucleic acid molecule devoid, in whole or part, of sequences normally associated with it in nature; or a sequence, as it exists in nature, but having heterologous sequences (as defined below) in association therewith.

The term "polynucleotide encoding a protein" as used herein refers to a DNA fragment or isolated DNA molecule encoding a protein, or the complementary strand thereto; but, RNA is not excluded, as it is understood in the art that thymidine (T) in a DNA sequence is considered equal to uracil (U) in an RNA sequence. Thus, RNA sequences for use in the invention, e.g., for use in RNA vectors, can be derived from DNA sequences, by thymidine (T) in the DNA sequence being considered equal to uracil (U) in RNA sequences.

A DNA "coding sequence" or a "nucleotide sequence encoding" a particular protein, is a DNA sequence which is transcribed and translated into a polypeptide in vitro or in vivo when placed under the control of appropriate regulatory elements. The boundaries of the coding sequence are determined by a start codon at the 5' (amino) terminus and a translation stop codon at the 3' (carboxy) terminus. A coding sequence can include, but is not limited to, prokaryotic sequences, cDNA from eukaryotic mRNA, genomic DNA sequences from eukaryotic (e.g., mammalian) DNA, and even synthetic DNA sequences. A transcription termination sequence will usually be located 3' to the coding sequence.

"Sequence identity" refers to the percent identity between two polynucleotide or two polypeptide moieties. Genes that share a high sequence identity or similarity support the hypothesis that they share a common ancestor and are therefore homologous. Sequence homology may also indicate common function. Two DNA, or two polypeptide sequences are similar to each other and may be homologous when the sequences exhibit at least about 80%, 81%, 82%, 83%, 84%, 85%, 86%, 87%, 88%, 89%, preferably at least about 90%, 91%, 92%, 93%, 94% and most preferably at least about 95%, 96%, 97%, 98%, 99%, 99.5%, 99.9% sequence identity over a defined length of the molecules. As used herein, Sequence identity also refers to sequences showing complete identity (100% sequence identity) to the specified DNA or polypeptide sequence.

Percent identity can be determined by hybridization of polynucleotides under conditions that form stable duplexes between similar regions, followed by digestion with single-stranded-specific nuclease(s), and size determination of the digested fragments. DNA sequences that are homologous can be identified in a Southern hybridization experiment under, for example, stringent conditions, as defined for that particular system. Defining appropriate hybridization conditions is within the skill of the art. See, e.g., Sambrook et al. supra; DNA Cloning, supra; Nucleic Acid Hybridization, supra.

Two nucleic acid fragments are considered to be "selectively hybridizable" to a polynucleotide if they are capable of specifically hybridizing to a nucleic acid or a variant thereof or specifically priming a polymerase chain reaction: (i) under typical hybridization and wash conditions, as described, for example, in Sambrook et al. supra and Nucleic Acid Hybridization, supra, (ii) using reduced stringency wash conditions that allow at most about 25-30% basepair mismatches, for example: 2×SSC, 0.1% SDS, room temperature twice, 30 minutes each; then 2×SSC, 0.1% SDS, 37° C. once, 30 minutes; then 2×SSC room temperature twice, 10 minutes each, or (iii) selecting primers for use in typical polymerase chain reactions (PCR) under standard conditions (described for example, in Saiki, et al. (1988) Science 239:487-491).

The term "capable of hybridizing under stringent conditions" as used herein refers to annealing a first nucleic acid to a second nucleic acid under stringent conditions as defined below. Stringent hybridization conditions typically permit the hybridization of nucleic acid molecules having at least 70% nucleic acid sequence identity with the nucleic acid molecule being used as a probe in the hybridization reaction. For example, the first nucleic acid may be a test sample or probe, and the second nucleic acid may be the sense or antisense strand of a nucleic acid or a fragment thereof. Hybridization of the first and second nucleic acids may be conducted under stringent conditions, e.g., high temperature and/or low salt content that tend to disfavor hybridization of dissimilar nucleotide sequences. Alternatively, hybridization of the first and second nucleic acid may be conducted under reduced stringency conditions, e.g. low temperature and/or high salt content that tend to favor hybridization of dissimilar nucleotide sequences. Low stringency hybridization conditions may be followed by high stringency conditions or intermediate medium stringency conditions to increase the selectivity of the binding of the first and second nucleic acids. The hybridization conditions may further include reagents such as, but not limited to, dimethyl sulfoxide (DMSO) or formamide to disfavor still further the hybridization of dissimilar nucleotide sequences. A suitable hybridization protocol may, for example, involve hybridization in 6×SSC (wherein 1×SSC comprises 0.015 M sodium citrate and 0.15 M sodium chloride), at 65° Celsius in an aqueous solution, followed by washing with 1×SSC at 65° C. Formulae to calculate appropriate hybridization and wash conditions to achieve hybridization permitting 30% or less mismatch between two nucleic acid molecules are disclosed, for example, in Meinkoth et al. (1984) Anal. Biochem. 138: 267-284; the content of which is herein incorporated by reference in its entirety. Protocols for hybridization techniques are well known to those of skill in the art and standard molecular biology manuals may be consulted to select a suitable hybridization protocol without undue experimentation. See, for example, Sambrook et al. (2001) Molecular Cloning: A Laboratory Manual, 3rd ed., Cold Spring Harbor Press, the contents of which are herein incorporated by reference in their entirety.

Typically, stringent conditions will be those in which the salt concentration is less than about 1.5 M sodium ion, typically about 0.01 to 1.0 M Na ion concentration (or other salts) from about pH 7.0 to about pH 8.3 and the temperature is at least about 30° Celsius for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° Celsius, and a wash in 1-2×SSC at 50 to 55° Celsius. Exemplary moderate stringency conditions include hybridization in 40 to 45% formamide, 1 M NaCl, 1% SDS at 37° Celsius, and a wash in 0.5-1×SSC at 55 to 60° Celsius. Exemplary high stringency conditions include hybridization in 50% formamide, 1 M NaCl, 1% SDS at 37° Celsius, and a wash in 0.1×SSC at 60 to 65° Celsius.

Methods and materials of the invention may be used more generally to evaluate a DNA sample from an animal, genetically type an individual animal, and detect genetic differences in animals. In particular, a sample of genomic DNA from an animal may be evaluated by reference to one or more controls to determine if a SNP, or group of SNPs, in or near a gene is present. Any method for determining genotype can be used for determining the genotype in the present invention. Such methods include, but are not limited to, amplimer sequencing, DNA sequencing, fluorescence spectroscopy, fluorescence resonance energy transfer (or "FRET")-based hybridization analysis, high throughput screening, mass spectroscopy, microsatellite analysis, nucleic acid hybridization, polymerase chain reaction (PCR), RFLP analysis and size chromatography (e.g., capillary or gel chromatography), all of which are well known to one of skill in the art. In particular, methods for determining nucleotide polymorphisms, particularly single nucleotide polymorphisms, are described in U.S. Pat. Nos. 6,514,700; 6,503,710; 6,468,742; 6,448,407; 6,410,231; 6,383,756; 6,358,679; 6,322,980; 6,316,230; and 6,287,766 and reviewed by Chen and Sullivan, Pharmacogenomics J 2003; 3(2):77-96, the disclosures of which are incorporated by reference in their entireties. Genotypic data useful in the methods of the invention and methods for the identification and selection of animal traits are based on the presence of SNPs.

A "restriction fragment" refers to a fragment of a polynucleotide generated by a restriction endonuclease (an enzyme that cleaves phosphodiester bonds within a polynucleotide chain) that cleaves DNA in response to a recognition site on the DNA. The recognition site (restriction site) consists of a specific sequence of nucleotides typically about 4-8 nucleotides long.

A "single nucleotide polymorphism" or "SNP" refers to a variation in the nucleotide sequence of a polynucleotide that differs from another polynucleotide by a single nucleotide difference. For example, without limitation, exchanging one A for one C, G or T in the entire sequence of polynucleotide constitutes a SNP. It is possible to have more than one SNP in a particular polynucleotide. For example, at one position in a polynucleotide, a C may be exchanged for a T, at another position a G may be exchanged for an A and so on. When referring to SNPs, the polynucleotide is most often DNA.

As used herein, a "template" refers to a target polynucleotide strand, for example, without limitation, an unmodified naturally-occurring DNA strand, which a polymerase uses as a means of recognizing which nucleotide it should next incorporate into a growing strand to polymerize the complement of the naturally-occurring strand. Such a DNA strand may be single-stranded or it may be part of a double-stranded DNA template. In applications of the present invention requiring repeated cycles of polymerization, e.g., the polymerase chain reaction (PCR), the template strand itself may become modified by incorporation of modified nucleotides, yet still serve as a template for a polymerase to synthesize additional polynucleotides.

A "thermocyclic reaction" is a multi-step reaction wherein at least two steps are accomplished by changing the temperature of the reaction.

A "variance" is a difference in the nucleotide sequence among related polynucleotides. The difference may be the deletion of one or more nucleotides from the sequence of one polynucleotide compared to the sequence of a related polynucleotide, the addition of one or more nucleotides or the substitution of one nucleotide for another. The terms "mutation," "polymorphism" and "variance" are used interchangeably herein. As used herein, the term "variance" in the singular is to be construed to include multiple variances; i.e., two or more nucleotide additions, deletions and/or substitutions in the same polynucleotide. A "point mutation" refers to a single substitution of one nucleotide for another.

As used herein, the terms "traits", "quality traits" or "physical characteristics" or "phenotypes" refer to advantageous properties of the animal resulting from genetics. Quality traits include, but are not limited to, the animal's genetic ability to efficiently metabolize energy, produce meat or milk, put on intramuscular fat or remain free from bruising due to trauma from horns during the process of handling. Physical characteristics include, but are not limited to, marbled, tender or lean meats and horned or polled status. The terms may be used interchangeably.

Statistical associations between individual SNP or SNP haplotypes and the phenotype of interest can be determined in a case-control study by utilizing the algorithms in computer software such as in PHASE2.1.1 (M. Stephens and P. Donnelly, Am. J. Human Genet. 73: 1162-1169, 2003) and Haploview (J. C. Barrett et al., Bioinformatics 21: 263-265, 2005).

A "computer system" refers to the hardware means, software means and data storage means used to compile the data of the present invention. The minimum hardware means of computer-based systems of the invention may comprise a central processing unit (CPU), input means, output means, and data storage means. Desirably, a monitor is provided to visualize structure data. The data storage means may be RAM or other means for accessing computer readable media of the invention. Examples of such systems are microcomputer workstations available from Silicon Graphics Incorporated and Sun Microsystems running Unix based, Linux, Windows NT, XP or IBM OS/2 operating systems.

"Computer readable media" refers to any media which can be read and accessed directly by a computer, and include, but are not limited to: magnetic storage media such as floppy discs, hard storage medium and magnetic tape; optical storage media such as optical discs or CD-ROM; electrical storage media such as RAM and ROM; and hybrids of these categories, such as magnetic/optical media. By providing such computer readable media, the data compiled on a particular animal can be routinely accessed by a user, e.g., a feedlot operator.

The term "data analysis module" is defined herein to include any person or machine, individually or working together, which analyzes the sample and determines the genetic information contained therein. The term may include a person or machine within a laboratory setting.

As used herein, the term "data collection module" refers to any person, object or system obtaining a tissue sample from an animal or embryo. By example and without limitation, the term may define, individually or collectively, the person or machine in physical contact with the animal as the sample is taken, the containers holding the tissue samples, the packaging used for transporting the samples, and the like. Advantageously, the data collector is a person. More advantageously, the data collector is a livestock farmer, a breeder or a veterinarian As used herein, the term "data storage system" refers to any person, object or system that compares the nucleotide sequence of the animal with other genotypes. By example and without limitation, the term may define, individually or collectively, the person or machine analyzing the samples, the containers holding the nucleotide samples, the packaging used for transporting the samples, and the like.

The term "network interface" is defined herein to include any person or computer system capable of accessing data, depositing data, combining data, analyzing data, searching data, transmitting data or storing data. The term is broadly defined to be a person analyzing the data, the electronic hardware and software systems used in the analysis, the databases storing the data analysis, and any storage media capable of storing the data. Non-limiting examples of network interfaces include people, automated laboratory equipment, computers and computer networks, data storage devices such as, but not limited to, disks, hard drives or memory chips.

The term "breeding history" as used herein refers to a record of the life of an animal or group of animals including, but not limited to, the location, breed, period of housing, as well as a genetic history of the animals, including parentage and descent therefrom, genotype, phenotype, transgenic history if relevant and the like.

The term "husbandry conditions" as used herein refers to parameters relating to the maintenance of animals including, but not limited to, shed or housing temperature, weekly mortality of a herd, water consumption, feed consumption, ventilation rate and quality, litter condition and the like.

The term "veterinary history" as used herein refers to vaccination data of an animal or group of animals, including, but not limited to, vaccine type(s), vaccine batch serial number(s), administered dose, target antigen, method of administering of the vaccine to the recipient animal(s), number of vaccinated animals, age of the animals and the vaccinator. Data relating to a serological or immunological response induced by the vaccine may also be included. "Veterinary history" as used herein is also intended to include the medication histories of the target animal(s) including, but not limited to drug and/or antibiotics administered to the animals including type of administered medication, quantity and dose rates, by whom and when administered, by what route, e.g., oral, subcutaneously and the like, and the response to the medication including desired and undesirable effects thereof.

The term "diagnostic data" as used herein refers to data relating to the health of the animal(s) other than data detailing the vaccination or medication history of the animal(s). For example, the diagnostic data may be a record of the infections experienced by the animal(s) and the response thereof to medications provided to treat such medications. Serological data including antibody or protein composition of the serum or other biofluids may also be diagnostic data useful to input in the methods of the invention. Surgical data pertaining to the animal(s) may be included, such as the type of surgical manipulation, outcome of the surgery and complications arising from the surgical procedure. "Diagnostic data" may also include measurements of such parameters as weight, morbidity, and other characteristics noted by a veterinary service such as the condition of the skin, feet, etc.

The term "welfare data" as used herein refers to the collective accumulation of data pertaining to an animal or group of animals including, but not limited to, a breeding history, a veterinary history, a welfare profile, diagnostic data, quality control data, or any combination thereof.

The term "welfare profile" as used herein refers to parameters such as weight, meat density, crowding levels in breeding or rearing enclosures, psychological behavior of the animal, growth rate and quality and the like.

The term "quality control" as used herein refers to the desired characteristics of the animal(s). For non-poultry animals such as cattle and sheep for example, such parameters include muscle quantity and density, fat content, meat tenderness, milk yield and quality, breeding ability, and the like.

The term "performance parameters" as used herein refers to such factors as meat yield, breeding yield, dairy form, meat quality and yield, productive life and the like that may be the desired goals from the breeding and rearing of the animal(s). Performance parameters may be either generated from the animals themselves, or those parameters desired by a customer or the market.

The term "nutritional data" as used herein refers to the composition, quantity and frequency of delivery of feed, including water, provided to the animal(s).

The term "food safety" as used herein refers to the quality of the meat from a livestock animal, including, but not limited to, preparation time, place and manner, storage of the food product, transportation route, inspection records, texture, color, taste, odor, bacterial content, parasitic content and the like.

It will be apparent to those of skill in the art that the data relating to the health and maintenance of the animals may be variously grouped depending upon the source or intention of the data collector and any one grouping herein is not therefore intended to be limiting.

Unless otherwise defined, all technical and scientific terms used herein have the same meaning as commonly understood by one of ordinary skill in the art of molecular biology. Although methods and materials similar or equivalent to those described herein can be used in the practice or testing of the present invention, suitable methods and materials are described herein.

In an embodiment wherein the gene(s) of interest is bovine Polled, the bovine Polled nucleotide sequence can be selected from, but is not limited to, the sequences corresponding to SEQ ID NO 1 through SEQ ID NO 42, or fragments thereof or a region of the bovine genome that comprises said sequence(s).

The single nucleotide polymorphism(s) of interest may be selected from the group comprising the nucleotide substitutions defined in SEQ ID NO 1 through SEQ ID NO 42 (FIG. 1 through FIG. 42).

The SNPs advantageous in the present invention are associated with certain economically valuable and heritable traits relating to quality in bovines. Therefore, it is an object of the present invention to determine the genotype of a given animal of interest as defined by the nucleotide substitutions defined in SEQ ID NO 1 through SEQ ID NO 42 (FIG. 1 through FIG. 42) according to the present invention. It is also contemplated that the genotype of the animal(s) may be defined by additional SNPs within the Polled gene(s) or within other genes identified with desirable traits or other characteristics, and in particular by a panel or panels of SNPs.

There are many methods known in the art for determining the sequence of DNA in a sample, and for identifying whether a given DNA sample contains a particular SNP. Any such technique known in the art may be used in performance of the methods of the present invention.

The methods of the present invention allow animals with certain economically valuable heritable traits to be identified based on the presence of SNPs in their genomes and particularly with SNPs located within the Polled genes. The methods further allow, by computer-assisted methods of the invention, to correlate SNP-associated traits with other data pertinent to the well-being and productive capacity of the animals, or group of animals.

To determine the genotype of a given animal according to the methods of the present invention, it is necessary to obtain a sample of genomic DNA from that animal. Typically, that sample of genomic DNA will be obtained from a sample of tissue or cells taken from that animal. A tissue or cell sample may be taken from an animal at any time in the lifetime of an animal but before the carcass identity is lost. The tissue sample can comprise hair, including roots, hide, bone, buccal swabs, blood, saliva, milk, semen, embryos, muscle or any internal organs. In the methods of the present invention, the source of the tissue sample, and thus also the source of the test nucleic acid sample, is not critical. For example, the test nucleic acid can be obtained from cells within a body fluid of the animal, or from cells constituting a body tissue of the animal. The particular body fluid from which cells are obtained is also not critical to the present invention. For example, the body fluid may be selected from the group consisting of blood, ascites, pleural fluid and spinal fluid. Furthermore, the particular body tissue from which cells are obtained is also not critical to the present invention. For example, the body tissue may be selected from the group consisting of skin, endometrial, uterine and cervical tissue. Both normal and tumor tissues can be used.

Typically, the tissue sample is marked with an identifying number or other indicia that relates the sample to the individual animal from which the sample was taken. The identity of the sample advantageously remains constant throughout the methods and systems of the invention thereby guaranteeing the integrity and continuity of the sample during extraction and analysis. Alternatively, the indicia may be changed in a regular fashion that ensures that the data, and any other associated data, can be related back to the animal from which the data was obtained.

The amount/size of sample required is known to those skilled in the art and for example, can be determined by the subsequent steps used in the method and system of the invention and the specific methods of analysis used. Ideally, the size/volume of the tissue sample retrieved should be as consistent as possible within the type of sample and the species of animal. For example, for cattle, non-limiting examples of sample sizes/methods include non-fatty meat: 0.0002 gm-10.0 gm; hide: 0.0004 gm-10.0 gm; hair roots: at least one and advantageously greater than five; buccal swabs: 15 to 20 seconds of rubbing with modest pressure in the area between outer lip and gum using, for example, a cytology brush; bone: 0.0002 gm-10.0 gm; blood: 30 μl to 50 ml.

Generally, the tissue sample is placed in a container that is labeled using a numbering system bearing a code corresponding to the animal, for example, to the animal's ear tag. Accordingly, the genotype of a particular animal is easily traceable at all times. The sampling device and/or container may be supplied to the farmer, a slaughterhouse or retailer. The sampling device advantageously takes a consistent and reproducible sample from individual animals while simultaneously avoiding any cross-contamination of tissue. Accordingly, the size and volume of sample tissues derived from individual animals would be consistent.

DNA can be isolated from the tissue/cells by techniques known to those skilled in the art (see, e.g., U.S. Pat. Nos. 6,548,256 and 5,989,431; Hirota et al. (1989) Jinrui Idengaku Zasshi. 34: 217-23 and John et al. (1991) Nucleic Acids Res. 19:408, the disclosures of which are incorporated by reference in their entireties). For example, high molecular weight DNA may be purified from cells or tissue using proteinase K extraction and ethanol precipitation. DNA, however, may be extracted from an animal specimen using any other suitable methods known in the art.

In one embodiment, the presence or absence of the SNP of the gene(s) of the present invention may be determined by sequencing the region of the genomic DNA sample that spans the polymorphic locus. Many methods of sequencing genomic DNA are known in the art, and any such method can be used, see for example Sambrook et al. (2001) Molecular Cloning: A Laboratory Manual, 3rd ed., Cold Spring Harbor Press. For example, as described below, a DNA fragment spanning the location of the SNP of interest can be amplified using the polymerase chain reaction. The amplified region of DNA form can then be sequenced using any method known in the art, for example using an automatic nucleic acid sequencer. The detection of a given SNP can then be performed using hybridization of probes and or using PCR-based amplification methods. Such methods are described in more detail below.

The methods of the present invention may use oligonucleotides useful as primers to amplify specific nucleic acid sequences of the Polled gene(s), advantageously of the region encompassing a Polled SNP. Such fragments should be of sufficient length to enable specific annealing or hybridization to the nucleic acid sample. The sequences typically will be about 8 to about 44 nucleotides in length. Longer sequences, e.g., from about 14 to about 50, may be advantageous for certain embodiments. The design of primers is well known to one of ordinary skill in the art.

Inventive nucleic acid molecules include nucleic acid molecules having at least 70% identity or similarity with a Polled gene or probes or primers derived therefrom such as at least 75% identity or similarity, preferably at least 80% identity or similarity, more preferably at least 85% identity or similarity such as at least 90% identity or similarity, more preferably at least 95% identity or similarity such as at least 97% identity or similarity. The nucleotide sequence similarity or homology or identity can be determined using the "Align" program of Myers and Miller, ("Optimal Alignments in Linear Space", CABIOS 4, 11-17, 1988) and available at NCBI. Alternatively or additionally, the terms "similarity" or "identity", for instance, with respect to a nucleotide sequence, is intended to indicate a quantitative measure of factual identity between two sequences. The percent sequence similarity can be calculated as $(N_{ref}-N_{dif})*100/N_{ref}$, wherein $N_{dif}$ is the total number of non-identical residues in the two sequences when aligned and wherein $N_{ref}$ is the number of residues in one of the sequences. Hence, the DNA sequence AGTCAGTC will have a sequence similarity of 75% with the sequence AATCAATC ($N_{ref}=8$; $N_{dif}=2$). Alternatively or additionally, "similarity" with respect to sequences refers to the number of positions with identical nucleotides divided by the number of nucleotides in the shorter of the two sequences wherein alignment of the two sequences can be determined in accordance with the Wilbur and Lipman algorithm (Wilbur and Lipman, 1983 PNAS USA 80:726), for instance, using a window size of 20 nucleotides, a word length of 4 nucleotides, and a gap penalty of 4, and computer-assisted analysis and interpretation of the sequence data including alignment can be conveniently performed using commercially available programs (e.g., Intelligenetics™ Suite, Intelligenetics Inc. CA). When RNA sequences are said to be similar, or have a degree of sequence identity with DNA sequences, thymidine (T) in the DNA sequence is considered equal to uracil (U) in the RNA sequence.

A probe or primer can be any stretch of at least 8, preferably at least 10, more preferably at least 12, 13, 14, or 15, such as at least 20, e.g., at least 23 or 25, for instance at least 27 or 30 nucleotides in or near a Polled gene which are unique to that location. As to PCR or hybridization primers or probes and optimal lengths therefor, reference is also made to Kajimura et al., GATA 7(4):71-79 (1990).

RNA sequences within the scope of the invention are derived from the DNA sequences, by thymidine (T) in the DNA sequence being considered equal to uracil (U) in RNA sequences.

The oligonucleotides can be produced by a conventional production process for general oligonucleotides. They can be produced, for example, by a chemical synthesis process or by a microbial process that makes use of a plasmid vector, a phage vector or the like. Further, it is suitable to use a nucleic acid synthesizer.

To label an oligonucleotide with the fluorescent dye, one of conventionally known labeling methods can be used (Tyagi & Kramer (1996) Nature Biotechnology 14: 303-308; Schofield et al. (1997) Appl. and Environ. Microbiol. 63: 1143-1147; Proudnikov & Mirzabekov (1996) Nucl. Acids Res. 24: 4532-4535). Alternatively, the oligonucleotide may be labeled with a radiolabel e.g., $^3$H, $^{125}$I, $^{35}$S, $^{14}$C, $^{32}$P, etc. Well-known labeling methods are described, for example, in Sambrook et al. (2001) Molecular Cloning: A Laboratory Manual, 3rd ed., Cold Spring Harbor Press. The label is coupled directly or indirectly to a component of the oligonucleotide according to methods well known in the art. Reversed phase chromatography or the like used to provide a nucleic acid probe for use in the present invention can purify the synthesized oligonucleotide labeled with a marker. An advantageous probe form is one labeled with a fluorescent dye at the 3'- or 5'-end and containing G or C as the base at the labeled end. If the 5'-end is labeled and the 3'-end is not labeled, the OH group on the C atom at the 3'-position of the 3'-end ribose or deoxyribose may be modified with a phosphate group or the like although no limitation is imposed in this respect.

During the hybridization of the nucleic acid target with the probes, stringent conditions may be utilized, advantageously along with other stringency affecting conditions, to aid in the hybridization. Detection by differential disruption is particularly advantageous to reduce or eliminate slippage hybridization among probes and target, and to promote more effective hybridization. In yet another aspect, stringency conditions may be varied during the hybridization complex stability determination so as to more accurately or quickly determine whether a SNP is present in the target sequence.

One method for determining the genotype at the polymorphic locus encompasses obtaining a nucleic acid sample, hybridizing the nucleic acid sample with a probe, and disrupting the hybridization to determine the level of disruption energy required wherein the probe has a different disruption energy for one allele as compared to another allele. In one example, there can be a lower disruption energy, e.g., melting temperature, for an allele that harbors a cytosine residue at a polymorphic locus, and a higher required energy for an allele with a different residue at that polymorphic locus. This can be achieved where the probe has 100% sequence identity with one allele (a perfectly matched probe), but has a single mismatch with the alternative allele. Since the perfectly matched probe is bound more tightly to the target DNA than the mismatched probe, it requires more energy to cause the hybridized probe to dissociate.

In a further step of the above method, a second ("anchor") probe may be used. Generally, the anchor probe is not specific to either allele, but hybridizes regardless of what nucleotide is present at the polymorphic locus. The anchor probe does not affect the disruption energy required to disassociate the hybridization complex but, instead, contains a complementary label for using with the first ("sensor") probe.

Hybridization stability may be influenced by numerous factors, including thermoregulation, chemical regulation, as well as electronic stringency control, either alone or in combination with the other listed factors. Through the use of stringency conditions, in either or both of the target hybridization step or the sensor oligonucleotide stringency step, rapid completion of the process may be achieved. This is desirable to achieve properly indexed hybridization of the target DNA to attain the maximum number of molecules at a test site with an accurate hybridization complex. By way of example, with the use of stringency, the initial hybridization step may be completed in ten minutes or less, more advantageously five minutes or less, and most advantageously two minutes or less. Overall, the analytical process may be completed in less than half an hour.

In one mode, the hybridization complex is labeled and the step of determining the amount of hybridization includes detecting the amounts of labeled hybridization complex at the test sites. The detection device and method may include, but is not limited to, optical imaging, electronic imaging, imaging with a CCD camera, integrated optical imaging, and mass spectrometry. Further, the amount of labeled or unlabeled probe bound to the target may be quantified. Such quantification may include statistical analysis. The labeled portion of the complex may be the target, the stabilizer, the probe or the hybridization complex in toto. Labeling may be by fluorescent labeling selected from the group of, but not limited to, Cy3, Cy5, Bodipy Texas Red, Bodipy Far Red, Lucifer Yellow, Bodipy 630/650-X, Bodipy R6G-X and 5-CR 6G. Colormetric labeling, bioluminescent labeling and/or chemiluminescent labeling may further accomplish labeling. Labeling further may include energy transfer between molecules in the hybridization complex by perturbation analysis, quenching, electron transport between donor and acceptor molecules, the latter of which may be facilitated by double stranded match hybridization complexes. Optionally, if the hybridization complex is unlabeled, detection may be accomplished by measurement of conductance differential between double stranded and non-double stranded DNA. Further, direct detection may be achieved by porous silicon-based optical interferometry or by mass spectrometry. In using mass spectrometry no fluorescent or other label is necessary. Rather detection is obtained by extremely high levels of mass resolution achieved by direct measurement, for example, by time of flight (TOF) or by electron spray ionization (ESI). Where mass spectrometry is contemplated, probes having a nucleic acid sequence of 50 bases or less are advantageous.

The label may be amplified, and may include, for example, branched or dendritic DNA. If the target DNA is purified, it may be un-amplified or amplified. Further, if the purified target is amplified and the amplification is an exponential method, it may be, for example, PCR amplified DNA or strand displacement amplification (SDA) amplified DNA. Linear methods of DNA amplification such as rolling circle or transcriptional runoff may also be used.

Where it is desired to amplify a fragment of DNA that comprises a SNP according to the present invention, the forward and reverse primers may have contiguous stretches of about 8, 9, 10, 11, 12, 13, 14, 15, 16, 17, 18, 19, 20, 21, 22, 23, 24, 25, 26, 27, 28, 29, 30 or any other length up to and including about 50 nucleotides in length. The sequences to which the forward and reverse primers anneal are advantageously located on either side of the particular nucleotide position that is substituted in the SNP to be amplified.

A detectable label can be incorporated into a nucleic acid during at least one cycle of an amplification reaction. Spectroscopic, photochemical, biochemical, immunochemical, electrical, optical or chemical means can detect such labels. Useful labels in the present invention include fluorescent dyes (e.g., fluorescein isothiocyanate, Texas red, rhodamine, and the like), radiolabels (e.g., $^{3}H$, $^{125}I$, $^{35}S$, $^{14}C$, $^{32}P$, etc.), enzymes (e.g. horseradish peroxidase, alkaline phosphatase etc.) calorimetric labels such as colloidal gold or colored glass or plastic (e.g. polystyrene, polypropylene, latex, etc.) beads. The label is coupled directly or indirectly to a component of the assay according to methods well known in the art. As indicated above, a wide variety of labels are used, with the choice of label depending on sensitivity required, ease of conjugation with the compound, stability requirements, available instrumentation, and disposal provisions. Non-radioactive labels are often attached by indirect means. Polymerases can also incorporate fluorescent nucleotides during synthesis of nucleic acids.

Reagents allowing the sequencing of reaction products can be utilized herein. For example, chain-terminating nucleotides will often be incorporated into a reaction product during one or more cycles of a reaction. Commercial kits containing the reagents most typically used for these methods of DNA sequencing are available and widely used. PCR exonuclease digestion methods for DNA sequencing can also be used. Many methods of sequencing genomic DNA are known in the art, and any such method can be used, see for example Sambrook et al. (2001) Molecular Cloning: A Laboratory Manual, 3rd ed., Cold Spring Harbor Press. For example, as described below, a DNA fragment spanning the location of the SNP of interest can amplified using the polymerase chain reaction or some other cyclic polymerase mediated amplification reaction. The amplified region of DNA can then be sequenced using any method known in the art. Advantageously, the nucleic acid sequencing is by automated methods (reviewed by Meldrum, (2000) Genome Res. 10: 1288-303, the disclosure of which is incorporated by reference in its entirety), for example using a Beckman CEQ 8000 Genetic Analysis System (Beckman Coulter Instruments, Inc.). Methods for sequencing nucleic acids include, but are not limited to, automated fluorescent DNA sequencing (see, e.g., Watts & MacBeath, (2001) Methods Mol Biol. 167: 153-70 and MacBeath et al. (2001) Methods Mol Biol. 167:119-52), capillary electrophoresis (see, e.g., Bosserhoff et al. (2000) Comb Chem High Throughput Screen. 3: 455-66), DNA sequencing chips (see, e.g., Jain, (2000) Pharmacogenomics. 1: 289-307), mass spectrometry (see, e.g., Yates, (2000) Trends Genet. 16: 5-8), pyrosequencing (see, e.g., Ronaghi, (2001) Genome Res. 11: 3-11), and ultrathin-layer gel electrophoresis (see, e.g., Guttman & Ronai, (2000) Electrophoresis. 21: 3952-64), the disclosures of which are hereby incorporated by reference in their entireties. The sequencing can also be done by a commercial company. Examples of such companies include, but are not limited to, the University of Georgia Molecular Genetics Instrumentation Facility (Athens, Ga.) or SeqWright DNA Technologies Services (Houston, Tex.).

A SNP-specific probe can also be used in the detection of the SNP in amplified specific nucleic acid sequences of the target gene, such as the amplified PCR products generated using the primers described above. In certain embodiments, these SNP-specific probes consist of oligonucleotide fragments. Advantageously, the fragments are of sufficient length to provide specific hybridization to the nucleic acid sample. The use of a hybridization probe of between 10 and 50 nucleotides in length allows the formation of a duplex molecule that is both stable and selective. Molecules having complementary sequences over stretches greater than 12 bases in length are generally advantageous, in order to increase stability and selectivity of the hybrid, and thereby improve the quality and degree of particular hybrid molecules obtained. One will generally prefer to design nucleic acid molecules having stretches of 16 to 24 nucleotides, or even longer where desired. A tag nucleotide region may be included, as at the 5' end of the primer that may provide a site to which an oligonucleotide sequencing primer may hybridize to facilitate the sequencing of multiple PCR samples.

The probe sequence must span the particular nucleotide position that may be substituted in the particular SNP to be detected. Advantageously, two or more different "allele-specific probes" may be used for analysis of a SNP, a first allele-specific probe for detection of one allele, and a second allele-specific probe for the detection of the alternative allele.

It will be understood that this invention is not limited to the particular primers and probes disclosed herein and is intended to encompass at least nucleic acid sequences that are hybridizable to the nucleotide sequence disclosed herein, the complement or a fragment thereof, or are functional sequence analogs of these sequences. It is also contemplated that a particular trait of an animal may be determined by using a panel of SNPs associated with that trait. Several economically relevant traits may be characterized by the presence or absence of one or more SNPs and by a plurality of SNPs in different genes. One or more panels of SNPs may be used in the methods of the invention to define the phenotypic profile of the subject animal.

Homologs (i.e., nucleic acids derived from other species) or other related sequences (e.g., paralogs) can be obtained under conditions of standard or stringent hybridization conditions with all or a portion of the particular sequence as a probe using methods well known in the art for nucleic acid hybridization and cloning.

The genetic markers, probes thereof, methods, and kits of the invention are also useful in a breeding program to select for breeding those animals having desirable phenotypes for various economically important traits, such as improved production, meat quality and yield, and meat tenderness. Continuous selection and breeding of animals, such as livestock, that are at least heterozygous and advantageously homozygous for desirable alleles of the Polled gene polymorphic sites associated with economically relevant production traits, would lead to a breed, line, or population having higher numbers of offspring with economically relevant production traits such as polled. Animals with the polled condition are advantageous for animal and human safety during handling, and for carcass quality due to reduced bruising. Thus, the Polled-associated SNPs of the present invention can be used as a selection tool.

Desirable phenotypes include, but are not limited to production, feed intake, growth rate, body weight, carcass merit and composition, polled status, and milk yield. Specific carcass traits with desirable phenotypes include, but are not limited to, additional carcass value (additional carc value, $), average daily gain (ADG, lb/d), backfat thickness (BFAT, in), calculated live weight (Calc Lv Wt, lb), calculated yield grade (cYG), days on feed (DOF, d), dressing percentage (DP, %), dry matter intake (DMI, lb), dry matter intake per day on feed (DMI per DOF, lb/d), hot carcass weight (HCW, lb), hot carcass weight value (HCW value, $), intramuscular fat content (IMF %, %), marbling score (MBS, 10 to 99), marbling score divided by days on feed (MBS/DOF), quality grade, less than or equal to select versus greater than or equal to choice (QG, <Se vs, >Ch), ribeye area (REA, in$^2$), ribeye area per hundred weight HCW (REA/cwt HCW, in$^2$/100 lb hot carcass weight (HCW) and subcutaneous fat depth (SFD) or freedom from bruising.

One aspect of the present invention provides for grouping animals and methods for managing livestock production comprising grouping livestock animals such as cattle according the genotype as defined by panels of SNPs, each panel comprising at least one SNP, one or more of which are in or near the Polled-associated gene(s) of the present invention. Other SNPs that may be included in panels of SNPs include, but not limited to, SNPs found in the calpain gene calpastatin gene, FGF8 gene, DECR 1 gene, GHR gene, TFAM gene, CRH gene, FABP4 gene, ghrelin gene, leptin gene, NPY gene, and/or the UCP2 gene. The genetic selection and grouping methods of the present invention can be used in conjunction with other conventional phenotypic grouping methods such as grouping animals by visible characteristics such as weight, frame size, breed traits, and the like. The methods of the present invention provide for producing cattle having improved heritable traits, and can be used to optimize the performance of livestock herds in areas such as breeding, feed intake, carcass/meat quality and milk production. The present invention provides methods of screening livestock to determine those more likely to develop a Polled condition by identifying the presence or absence of one or more gene polymorphisms correlated with the Polled phenotype.

As described above, and in the Examples, the phenotypic trait with which the SNPs of the present invention may be associated is the presence or absence of horns. The phenotypic and genetic trait can be tested using the methods described in the Examples, or using any suitable methods known in the art. Using the methods of the invention, a farmer, or feedlot operator, or the like, can group cattle according to each animal's genetic propensity for Polled, as determined by SNP genotype. The cattle are tested to determine homozygosity or heterozygosity with respect to the SNP alleles of the gene.

The individual genotypic data derived from a panel or panels of SNPs for each animal or a herd of animals can be recorded and associated with various other data of the animal, e.g. health information, parentage, husbandry conditions, vaccination history, herd records, subsequent food safety data and the like. Such information can be forwarded to a government agency to provide traceability of an animal or meat product, or it may serve as the basis for breeding, feeding and marketing information. Once the data have or have not been associated with other data, the data are stored in an accessible database, such as, but not limited to, a computer database or a microchip implanted in the animal. The methods of the invention may provide an analysis of the input data that may be compared with parameters desired by the operator. These parameters include, but are not limited to, such as breeding goals, vaccination levels of a herd. If the performance or properties of the animals deviates from the desired goals, the computer-based methods may trigger an alert to allow the operator to adjust vaccination doses, medications, feed etc accordingly.

The results of the analysis provide data that are associated with the individual animal or to the herd, in whole or in part, from which the sample was taken. The data are then kept in an accessible database, and may or may not be associated with other data from that particular individual or from other animals.

Data obtained from individual animals may be stored in a database that can be integrated or associated with and/or cross-matched to other databases. The database along with the associated data allows information about the individual animal to be known through every stage of the animal's life, i.e., from conception to consumption of the animal product.

The accumulated data and the combination of the genetic data with other types of data of the animal provides access to information about parentage, identification of herd, health information including vaccinations, exposure to diseases, feedlot location, diet and ownership changes. Information such as dates and results of diagnostic or routine tests are easily stored and attainable. Such information would be especially valuable to companies, particularly those who seek superior breeding lines.

Each animal may be provided with a unique identifier. The animal can be tagged, as in traditional tracing programs or have implant computer chips providing stored and readable data or provided with any other identification method which associates the animal with its unique identifier.

The database containing the SNP-based genotype results for each animal or the data for each animal can be associated or linked to other databases containing data, for example, which may be helpful in selecting traits for grouping or sub-grouping of an animal. For example, and not for limitation, data pertaining to animals having particular vaccination or medication protocols, can optionally be further linked with data pertaining to animals having food from certain food sources. The ability to refine a group of animals is limited only by the traits sought and the databases containing information related to those traits.

Databases that can usefully be associated with the methods of the invention include, but are not limited to, specific or general scientific data. Specific data includes, but is not limited to, breeding lines, sires, dames, and the like, other animals' genotypes, including whether or not other specific animals possess specific genes, including transgenic genetic elements, location of animals which share similar or identical genetic characteristics, and the like. General data include, but are not limited to, scientific data such as which genes encode for specific quality characteristics, breed association data, feed data, breeding trends, and the like.

One method of the present invention includes providing the animal owner or customer with sample collection equipment, such as swabs and tags useful for collecting samples from which genetic data may be obtained. Advantageously, the packaging is encoded with a bar code label. The tags are encoded with the same identifying indicia, advantageously with a matching bar code label. Optionally, the packaging contains means for sending the tags to a laboratory for analysis. The optional packaging is also encoded with identifying indicia, advantageously with a bar code label.

The method optionally includes a system wherein a database account is established upon ordering the sampling equipment. The database account identifier corresponds to the identifying indicia of the tags and the packaging. Upon shipment of the sampling equipment in fulfillment of the order, the identifying indicia are recorded in a database. Advantageously, the identifier is a bar code label which is scanned when the tags are sent. When the tags are returned to the testing facility, the identifier is again recorded and matched to the information previously recorded in the database upon shipment of the vial to the customer. Once the genotyping is completed, the information is recorded in the database and coded with the unique identifier. Test results are also provided to the customer or animal owner.

The data stored in the genotype database can be integrated with or compared to other data or databases for the purpose of identifying animals based on genetic propensities. Other data or databases include, but are not limited to, those containing information related to SNP-based DNA testing, vaccination, Sure Health pre-conditioning program, estrus and pregnancy results, hormone levels, food safety/contamination, somatic cell counts, mastitis occurrence, diagnostic test results, milk protein levels, milk fat, vaccine status, health records, mineral levels, trace mineral levels, herd performance, and the like.

The present invention, therefore, encompasses computer-assisted methods for tracking the breeding and veterinary histories of livestock animals encompassing using a computer-based system comprising a programmed computer comprising a processor, a data storage system, an input device and an output device, and comprising the steps of generating a profile of a livestock animal by inputting into the programmed computer through the input device genotype data of the animal, wherein the genotype may be defined by a panel of at least two single nucleotide polymorphisms that predict at least one physical trait of the animal, inputting into the programmed computer through the input device welfare data of the animal, correlating the inputted welfare data with the phenotypic profile of the animal using the processor and the data storage system, and outputting a profile of the animal or group of animals to the output device.

The databases and the analysis thereof will be accessible to those to whom access has been provided. Access can be provided through rights to access or by subscription to specific portions of the data. For example, the database can be accessed by owners of the animal, the test site, the entity providing the sample to the test site, feedlot personnel, and veterinarians. The data can be provided in any form such as by accessing a website, fax, email, mailed correspondence, automated telephone, or other methods for communication. These data can also be encoded on a portable storage device, such as a microchip, that can be implanted in the animal. Advantageously, information can be read and new information added without removing the microchip from the animal.

The present invention comprises systems for performing the methods disclosed herein. Such systems comprise devices, such as computers, internet connections, servers, and storage devices for data. The present invention also provides for a method of transmitting data comprising transmission of information from such methods herein discussed or steps thereof, e.g., via telecommunication, telephone, video conference, mass communication, e.g., presentation such as a computer presentation (e.g., POWERPOINT), internet, email, documentary communication such as computer programs (e.g., WORD) and the like.

Systems of the present invention may comprise a data collection module, which includes a data collector to collect data from an animal or embryo and transmit the data to a data analysis module, a network interface for receiving data from the data analysis module, and optionally further adapted to combine multiple data from one or more individual animals, and to transmit the data via a network to other sites, or to a storage device.

More particularly, systems of the present invention comprise a data collection module, a data analysis module, a network interface for receiving data from the data analysis module, and optionally further adapted to combine multiple data from one or more individual animals, and to transmit the data via a network to other sites, and/or a storage device. For example, the data collected by the data collection module leads to a determination of the absence or presence of a SNP of a gene in the animal or embryo, and for example, such data is transmitted when the feeding regimen of the animal is planned.

In one embodiment where the data is implanted on a microchip on a particular animal, the farmer can optimize the efficiency of managing the herd because the farmer is able to identify the genetic predispositions of an individual animal as well as past, present and future treatments (e.g., vaccinations and veterinarian visits). The invention, therefore also provides for accessing other databases, e.g., herd data relating to genetic tests and data performed by others, by datalinks to other sites. Therefore, data from other databases can be transmitted to the central database of the present invention via a network interface for receiving data from the data analysis module of the other databases.

The invention relates to a computer system and a computer readable media for compiling data on an animal, the system containing inputted data on that animal, such as but not limited to, vaccination and medication histories, DNA testing, thyroglobulin testing, detection of circulating hormone leves (eg. leptin), bovine spongiform encephalopathy (BSE) diagnosis, brucellosis vaccination, FMD (foot and mouth disease) vaccination, BVD (bovine viral diarrhea) vaccination, Sure Health pre-conditioning program, estrus and pregnancy results, tuberculosis, hormone levels, food safety/contamination, somatic cell counts, mastitis occurrence, diagnostic test results, milk protein levels, milk fat, vaccine status, health records, mineral levels, trace mineral levels, herd performance, and the like. The data of the animal can also include prior treatments as well as suggested tailored treatment depending on the genetic predisposition of that animal toward a particular disease.

The invention also provides for a computer-assisted method for improving animal production comprising using a computer system, e.g., a programmed computer comprising a processor, a data storage system, an input device and an output device, the steps of inputting into the programmed computer through the input device data comprising a breeding, veterinary, medication, diagnostic data and the like of an animal, correlating a physical characteristic predicted by the genotype using the processor and the data storage system, outputting to the output device the physical characteristic correlated to the genotype, and feeding the animal a diet based upon the physical characteristic, thereby improving livestock production.

The invention further provides for a computer-assisted method for optimizing efficiency of feedlots for livestock comprising using a computer system, e.g., a programmed computer comprising a processor, a data storage system, an input device and an output device, and the steps of inputting into the programmed computer through the input device data comprising a breeding, veterinary history of an animal, correlating the breeding, veterinary histories using the processor and the data storage system, outputting to the output device the physical characteristic correlated to the genotype, and feeding the animal a diet based upon the physical characteristic, thereby optimizing efficiency of feedlots for livestock.

The invention further comprehends methods of doing business by providing access to such computer readable media and/or computer systems and/or data collected from animals to users; e.g., the media and/or sequence data can be accessible to a user, for instance on a subscription basis, via the Internet or a global communication/computer network; or, the computer system can be available to a user, on a subscription basis.

In one embodiment, the invention provides for a computer system for managing livestock comprising physical characteristics and databases corresponding to one or more animals. In another embodiment, the invention provides for computer readable media for managing livestock comprising physical characteristics and veterinary histories corresponding to one or more animals. The invention further provides methods of doing business for managing livestock comprising providing to a user the computer system and media described above or physical characteristics and veterinary histories corresponding to one or more animals. The invention further encompasses methods of transmitting information obtained in any method or step thereof described herein or any information described herein, e.g., via telecommunications, telephone, mass communications, mass media, presentations, internet, email, etc.

The invention further encompasses kits useful for screening nucleic acid isolated from one or more bovine individuals for allelic variation of any one of the mitochondrial transcription factor genes, and in particular for any of the SNPs described herein, wherein the kits may comprise at least one oligonucleotide selectively hybridizing to a nucleic acid comprising any one of the one or more of which are Polled-associated sequences described herein and instructions for using the oligonucleotide to detect variation in the nucleotide corresponding to the SNP of the isolated nucleic acid.

One embodiment of this aspect of the invention provides an oligonucleotide that specifically hybridizes to the isolated nucleic acid molecule of this aspect of the invention, and wherein the oligonucleotide hybridizes to a portion of the isolated nucleic acid molecule comprising any one of the polymorphic sites in the Polled-associated sequences described herein.

Another embodiment of the invention is an oligonucleotide that specifically hybridizes under high stringency conditions to any one of the polymorphic sites of the Polled-associated gene(s), wherein the oligonucleotide is between about 18 nucleotides and about 50 nucleotides.

In another embodiment of the invention, the oligonucleotide comprises a central nucleotide specifically hybridizing with a Polled-associated gene(s) polymorphic site of the portion of the nucleic acid molecule.

Another aspect of the invention is a method of identifying a Polled-associated polymorphisms in a nucleic acid sample comprising isolating a nucleic acid molecule encoding Polled-associated genes or a fragment thereof and determining the nucleotide at the polymorphic site.

Another aspect of the invention is a method of screening cattle to determine those bovines more likely to exhibit a biological difference in production quality comprising the steps of obtaining a sample of genetic material from a bovine; and assaying for the presence of a genotype in the bovine which is associated with production quality, the genotype characterized by polymorphisms in the Polled-associated genes.

In other embodiments of this aspect of the invention, the step of assaying is selected from the group consisting of: restriction fragment length polymorphism (RFLP) analysis, minisequencing, MALDI-TOF, SINE, heteroduplex analysis, single strand conformational polymorphism (SSCP), denaturing gradient gel electrophoresis (DGGE) and temperature gradient gel electrophoresis (TGGE).

In various embodiments of the invention, the method may further comprise the step of amplifying a region of or near the Polled-associated gene or a portion thereof that contains the polymorphism. In other embodiments of the invention, the amplification may include the step of selecting a forward and a reverse sequence primer capable of amplifying a region of the Polled-associated gene.

Another aspect of the invention is a computer-assisted method for predicting which livestock animals possess a biological difference in production quality comprising: using a computer system, e.g., a programmed computer comprising a processor, a data storage system, an input device and an output device, the steps of: (a) inputting into the programmed computer through the input device data comprising a Polled-associated genotype of an animal, (b) correlating production quality predicted by the Polled-associated genotype using the processor and the data storage system and (c) outputting to the output device the production quality correlated to the Polled-associated genotype, thereby predicting which livestock animals possess a particular quality.

Yet another aspect of the invention is a method of doing business for managing livestock comprising providing to a user computer system for managing livestock comprising physical characteristics and genotypes corresponding to one or more animals or a computer readable media for managing livestock comprising physical characteristics and genotypes corresponding to one or more animals or physical characteristics and genotypes corresponding to one or more animals.

The invention described herein is a SNP-based test in which data have been generated on a breed-by-breed basis and thus identifying breed-specific Polled haplotypes. There have been no assumptions regarding the origin of the Polled mutation (ie. whether there was a single or multiple mutation events), but it has been assumed that the specific mutation lies within a 1.7 Mb region near the centromere on bovine chromosome 1 in all breeds of interest.

The invention will now be further described by way of the following non-limiting examples.

EXAMPLES

Example 1

This Example provides DNA loci, genetic polymorphisms and significant associations with Polled-associated genes. A linkage map of Bovine Chromosome 1 (BTA1) is shown in FIG. 43 which shows localization of Poll to the region between IFNAR and SOD. Drogemuller et al. (2005) have localized Poll between BM6438 and RP42-218J17_MS1.

The Polled mutation lies within a 1.7 Mb region on bovine chromosome 1. In this example, we identified SNPs that spanned this 1.7 Mb interval, by mining the bovine genome sequence, by comparison of bacterial artificial chromosome (BAC) end sequences to the bovine genome sequence or from in-house sequence data. The relative position of SNPs was determined based on a physical map of the interval. SNPs are named based on their position in build 3.0 of the bovine genome sequence. For reference, FIG. 47 provides a comparison of horn/poll marker coordinates in successive releases of the bovine genome sequence. A SNPlex assay (Applied Biosystems) of 44 SNP probes was developed and used 42 SNPs in the association study. FIGS. 1-42 list the 42 SNPs and 250 bp of flanking sequence on either side of the specific SNP.

Example 2

Breeds of interest in this study were Limousin, Hereford, Angus, Red Angus, Simmental, Gelbvieh, Charolais, Brahman, Jersey and Holstein. We identified animals based on phenotypic information recorded in semen catalogs or at breed association websites. To ensure animals used for discovery were as unrelated as possible we constructed 5-generation pedigrees and used those animals with relationship coefficients <0.0625. In FIG. 44 a compilation of breed-specific Minor Allele Frequencies is presented.

For Limousin, we used 16 unrelated animals (32 chromosomes) for the discovery phase. A case/control study was performed with horned animals coded as controls and polled animals as case. Haplotypes were reconstructed for the 14 SNPs using PHASE software and differences in the frequencies of case vs. control haplotypes were investigated. Significance of the association of particular haplotypes with horned vs. polled phenotypes was also investigated using Haploview software. Data were permutated 10,000 times to establish empirical significance thresholds. Three SNPs (A1872077G, G2288436A, C2332892T) were sufficient to distinguish horned, heterozygous polled or homozygous polled individuals based on phased haplotype data. T1872200C is in complete disequilibrium with A1872077G and could be used instead. Two additional SNPs (T2101528C, T2214142A) were needed to correctly diagnose these phenotypes based on genotypes instead of haplotypes. T2220054C, T2220178 and C2225310T are in complete disequilibrium with T2214142A and could be used instead. The haplotypes for the 5 SNP markers for Limousin are listed in Table 1 and the P-values associated with individual markers or haplotypes are in Table 2.

Example 3

A blind test was performed to investigate the accuracy of predictions from the 5 marker haplotypes. Twenty five Limousin DNA samples were extracted and coded to keep them blind from the individual performing analysis. A SNPlex assay was performed and the resultant genotypes were phased as previously. Both alleles could be assigned for 23 individuals. A haplotype that had not previously been observed was seen in 2 individuals, so these could not be assigned blind. For the remaining 23 individuals, the predicted phenotypes matched the breed association records of phenotypes with 100% accuracy. A final check of the significance of the associations was performed by creating a dataset combining all individuals (original discovery set and blind-tested). After 10,000 permutations of the data, the best permutation chi-square was 19.212 while the best observed chi-square was 28.293 for SNP C2332892T. This corresponds to a P-value of $1 \times 10^{-7}$.

Example 4

For Hereford, 32 unrelated animals (64 chromosomes) were used for the discovery phase. As in the example for Limousin (Example 2), a case/control study was performed after reconstructing the haplotypes for 28 SNPs using PHASE software. Five SNPs (A1356048G, T2101528C, T2214142A, G2333140A, and T2816109G) were sufficient to distinguish horned, heterozygous polled or homozygous polled individuals based on phased haplotype data. As for the Limousin data, T2220054C, T2220178 and C2225310T are in complete disequilibrium with T2214142A and could be used instead. C2338338T is in complete linkage disequilibrium with G2333140A and C2816370G is in complete linkage disequilibrium with T2816109G. After 10,000 permutations of the data, the best permutation chi-square was 23.863 while the best observed chi-square was 32.789 for SNP T2816109C. This corresponds to a P-value of $1 \times 10^{-8}$ (Table 3).

Example 5

Haplotypes associated with the polled phenotype in the Angus and Red Angus breeds were identified and characterized (Table 4). A predictive test for the horned or polled phenotypes in Gelbvieh was also developed (Table 5) and has gone through a blind testing phase to verify accuracy. The polled phenotypes in Gelbvieh were derived from the Angus and/or Red Angus breeds. This is a predictive test and at present is suitable for purebred cattle.

For Angus and Red Angus, 56 unrelated animals (112 chromosomes) were used in a combined analysis. Because all individuals in these breeds are polled, haplotypes were simply reconstructed for the 28 SNP using PHASE software. These haplotypes are presented in Table 4. It is expected that in breeds that were originally horned, the polled was often introgressed from Angus and so polled haplotypes in those breeds are derived from Angus haplotypes.

For Gelbvieh, 36 unrelated animals (72 chromosomes) were used for the discovery phase. A case/control study was performed with horned animals (n=7) coded as controls and polled animals (n=29) as case. Haplotypes were reconstructed for the 23 polymorphic SNP in Gelbvieh using PHASE software and differences in the frequencies of case vs. control haplotypes were investigated. Significance of the association of particular haplotypes with horned vs. polled phenotypes was also investigated using Haploview software. Data were permutated 10,000 times to establish empirical significance thresholds. Six SNP from the Limousin and Hereford assays (A1356048G, T2220054C, G2288436A, C2332892T, G2333140A, T2816109G, C2816370G) were sufficient to correctly distinguish all but one of the observed horned or polled haplotypes. C2816370G is in complete disequilibrium with T2816109G and could be used instead. Two additional SNP (T2128551C, T2650867A) were needed to correctly distinguish horned and polled individuals carrying the remaining 6-marker haplotype. The haplotypes for the 8 SNP markers for Gelbvieh are listed in Table 5.

Example 6

Haplotypes associated with the polled phenotype in the Charolais, Shorthorn and Jersey breeds were identified and characterized (Table 6). This is a predictive test and is suitable for purebred cattle. We identified animals based on phenotypic information recorded in semen catalogs or at breed association websites. To ensure animals used for discovery were as unrelated as possible we constructed 5-generation pedigrees and used those animals with relationship coefficients <0.0625. Subsequently we obtained progeny records by type of dam (horned, polled or scurred) to verify the phenotype of the study animals.

For Charolais, 49 unrelated animals (98 chromosomes) were used for the discovery phase. A case/control study was performed with the horned animals (n=7) coded as controls and polled animals (n=42) as case. Haplotypes were reconstructed for the 23 polymorphic SNP in Charolais using PHASE software and differences in the frequencies of case vs. control haplotypes were investigated. Significance of the association of particular haplotypes with horned vs. polled phenotypes was also investigated using Haploview software. Data were permutated 10,000 times to establish empirical significance thresholds. Four SNP from the Limousin and Hereford assays (A1872077G, T2214142A, C2332892T, T2816109G), plus two additional SNP (G1013610C, A1731905G) were sufficient to correctly distinguish all of the observed horned or polled haplotypes. The haplotypes for the 8 SNP markers for Charolais are listed in Table 6.

For Shorthorn, 41 unrelated animals (82 chromosomes) were used for the discovery phase. A case/control study was performed with horned animals (n=14) coded as controls and polled animals (n=27) as case. Haplotypes were reconstructed for the 24 polymorphic SNP in Shorthorn using PHASE and Haploview software as for Charolais. Six SNP from the Limousin and Hereford assays (T2101528C, T2214142A, G2288436A, C2332892T, G2333140A, T2816109G), one SNP from the Gelbvieh assay (T2128551C) and one additional SNP that was also used for Charolais (A1731905G) were sufficient to correctly distinguish all but one of the observed horned or polled haplotypes. The haplotypes for the 8 SNP markers for Shorthorn are listed in Table 7.

For Jersey, 24 animals (48 chromosomes) were used for the discovery phase and performed a case/control study as for the beef breeds with the horned animals (n=10) coded as controls and polled animals (n=14) as case. Haplotypes were reconstructed for 20 polymorphic SNP with PHASE and Haploview software as previously described. Four SNP from the Limousin and Hereford assays (A1356048G, T2101528C, G2288436A, G2333140A) were sufficient to correctly distinguish each of the horned and polled haplotypes observed. The haplotypes for the 4 SNP markers for Jersey are listed in Table 8.

TABLE 1

Limousin haplotypes for markers A1872077G, T2101528C, T2214142A, G2288436A, C2332892T

| Haplotype | Phenotype |
|---|---|
| GTTAT | horn |
| GTTAC | horn |
| GTTGT | horn |
| GTTGC | horn |
| GTAAT | horn |
| GTAAC | horn |
| GTAGT | horn |
| GTAGC | horn |
| GCTAT | horn |
| GCTAC | horn |
| GCTGT | horn |
| GCTGC | horn |

TABLE 1-continued

Limousin haplotypes for markers A1872077G, T2101528C, T2214142A, G2288436A, C2332892T

| Haplotype | Phenotype |
|---|---|
| GCAAT | horn |
| GCAAC | horn |
| GCAGT | horn |
| GCAGC | horn |
| ATTAT | horn |
| ATTAC | inconclusive |
| ATTGT | horn |
| ATAAT | horn |
| ATAAC | horn |
| ATAGT | horn |
| ACTAT | horn |
| ACTAC | horn |
| ACTGT | horn |
| ACAAT | horn |
| ACAAC | horn |
| ACAGT | horn |
| ACAGC | poll |
| ATTGC | poll |
| ACTGC | poll |
| ATAGC | poll |

TABLE 2

Markers associated with detection of polled in Limousin

| # | Name | Associated Allele | Case | Control Ratios | Chi Square | P Value |
|---|---|---|---|---|---|---|
| 1 | 1872077 | A | 45:9 | 9:19 | 21.488 | 3.5608E−6 |
| 2 | 1872200 | T | 45:9 | 9:19 | 21.488 | 3.5608E−6 |
| 3 | 2101528 | C | 15:39 | 5:23 | 0.984 | 0.3212 |
| 4 | 2214142 | A | 14:40 | 3:25 | 2.596 | 0.1071 |
| 5 | 2220054 | C | 14:40 | 3:25 | 2.596 | 0.1071 |
| 6 | 2220178 | A | 14:40 | 3:25 | 2.596 | 0.1071 |
| 7 | 2225310 | T | 14:40 | 3:25 | 2.596 | 0.1071 |
| 8 | 2288436 | G | 40:14 | 4:24 | 26.507 | 2.6257E−7 |
| 9 | 2332892 | C | 40:13 | 4.24 | 28.293 | 1.0427E−7 |

| Haplotype | Frequency | Case | Control Ratios | Chi Square | P Value |
|---|---|---|---|---|---|
| Block 1 (1872077, 1872200) | | | | | |
| AT | 0.659 | 45.0:9.0 | 9.0:19.0 | 21.488 | 3.5608E−6 |
| GC | 0.341 | 9.0:45.0 | 19.0:9.0 | 21.488 | 3.5608E−6 |
| Block 2 (2214142, 2220054, 2220178, 2225310, 2288436) | | | | | |
| TTTCA | 0.463 | 14.0:40.0 | 24.0:4.0 | 26.507 | 2.6257E−7 |
| TTTCG | 0.329 | 26.0:28.0 | 1.0:27.0 | 16.590 | 4.6387E−5 |
| ACATG | 0.207 | 14.0:40.0 | 3.0:25.0 | 2.596 | 0.1071 |

TABLE 3

Markers associated with detection of Polled in Hereford

| # | Name | Associated Allele | Case | Control Ratios | Chi Square | P Value |
|---|------|-------------------|------|----------------|------------|---------|
| 1 | 1356048 | G | 30:6 | 10:16 | 13.278 | 3.0E−4 |
| 3 | 2101528 | T | 21:12 | 6:22 | 10.259 | 0.0014 |
| 4 | 2214142 | T | 32:2 | 13:15 | 17.547 | 2.8028E−5 |
| 5 | 2220054 | T | 34:2 | 13:15 | 18.615 | 1.5996E−5 |
| 6 | 2220178 | T | 34:2 | 13:15 | 18.615 | 1.5996E−5 |
| 7 | 2225310 | C | 34:2 | 13:15 | 18.615 | 1.5996E−5 |
| 8 | 2333140 | G | 34:2 | 13:15 | 14.663 | 1.0E−4 |
| 9 | 2338338 | C | 34:2 | 14:12 | 14.234 | 2.0E−4 |
| 10 | 2816109 | T | 31:5 | 24:32 | 1.027 | 2.0E−8 |
| 11 | 2806370 | C | 31:5 | 22:30 | 2.983 | 1.0E−8 |

Block 1 (2214142, 2220054, 2220178, 2225310)

| Haplotype | Frequency | Case | Control Ratios | Chi Square | P Value |
|-----------|-----------|------|----------------|------------|---------|
| TTTC | 0.734 | 34.0:2.0 | 13.0:15.0 | 18.615 | 1.5996E−5 |
| ACAT | 0.266 | 2.0:34.0 | 15.0:13.0 | 18.615 | 1.5996E−5 |

Block 2 (2333140, 2338338)

| Haplotype | Frequency | Case | Control Ratios | Chi Square | P Value |
|-----------|-----------|------|----------------|------------|---------|
| GC | 0.766 | 34.0:2.0 | 15.0:13.0 | 14.663 | 1.0E−4 |
| AT | 0.234 | 2.0:34.0 | 13.0:15.0 | 14.663 | 1.0E−4 |

Block 3 (2816109, 2816370)

| Haplotype | Frequency | Case | Control Ratios | Chi Square | P Value |
|-----------|-----------|------|----------------|------------|---------|
| TC | 0.547 | 31.0:5.0 | 4.0:24.0 | 32.789 | 1.0272E |
| GG | 0.453 | 5.0:31.0 | 24.0:4.0 | 32.789 | 1.0272E |

Hereford haplotypes for markers A1356048G, T2101528C, T2214142A, G2333140A, T2816109G

| Haplotype | Phenotype | Score |
|-----------|-----------|-------|
| ACAAG | Horned | H |
| ACAGG | Horned | H |
| ACAGT | Horned | H |
| ACTGG | Horned | H |
| ACTGT | Horned | H |
| ATAGT | Horned | H |
| ATTAT | Inconsistent | I |
| ATTGG | Horned | H |
| ATTGT | Horned | H |
| GCAAG | Horned | H |
| GCAAT | Horned | H |
| GCAGG | Horned | H |

TABLE 3-continued

Markers associated with detection of Polled in Hereford

| | | |
|---|---|---|
| GCAGT | Horned | H |
| GCTGG | Horned | H |
| GCTGT | Polled | P |
| GTTAT | Polled | P |
| GTTGG | Polled | P |
| GTTGT | Inconsistent | I |

TABLE 4

28 Nucleotide-marker haplotypes associated with detection of Polled in Angus and Red Angus. Markers are ordered according to their positions in Btau3.0: 1013610-1352705-1352905-1356048-1431709-1438531-1731905-1872077-1872200-2101528-2128551-2214142-2220054-2220178-2225310-2288436-2332892-2333140-2338338-2640799-2648129-2650867-2651006-2657651-2676311-2816109-2816370-2820224

| SEQ ID NO: | Haplotype | N |
|---|---|---|
| 80 | GTCGGTAATTCACATGCATATTGGCTCT | 8 |
| 81 | GTCGGTAATTCACATGCGCATTGGCTCT | 22 |
| 82 | GTCGGTAATTTTTTCGTGCATTGGCTCT | 2 |
| 83 | GTCAGTAATTCTTTCGCACATTGGCTCT | 20 |
| 84 | GTCAGTAATTCTTTCGCACATTGGCGGT | 1 |
| 85 | GTCAGTAATTCTTTCGCACATAGCCTCT | 2 |
| 86 | GTCAGTAATTCTTTCACACATTGGCTCT | 1 |
| 87 | GTCAGTAATCTTTTCGCGCATTGGCTCT | 15 |
| 88 | GTCAGTAGTTCACTCGTACATTGGCTGT | 1 |
| 89 | GAGAGTAATTCTTTCACACATTGGCTCT | 2 |
| 90 | GAGAGTAATTCTTTCACACATAGCCTCT | 5 |
| 91 | GAGAGTAATTTTTTCACATATAGCCTCT | 9 |
| 92 | CTCGGTAATTCTTTCGCACATTGGCTCT | 7 |
| 93 | CTCGGTAATTCTTTCACACATTGGCTCT | 1 |
| 94 | CTCGGTAATTCTTTCACACATAGCCTCT | 11 |
| 95 | CTCAGTAATTCTTTCGCACATTGGCTCT | 2 |
| 96 | CAGAGTAATTTTTTCACATATAGCCTCT | 3 |

TABLE 5

Observed eight-marker haplotypes to distinguish horned and polled in Gelbvieh. Markers are ordered according to their positions in Btau3.0: 1356048-2128551-2220054-2288436-2332892-2333140-2650867-2816109

| Haplotype | Assoc Phenotype |
|---|---|
| ACTACAAT | Polled |
| ACTGCATT | Polled |
| ACTGCGAT | Horned |
| ACTGCGTT | Horned |
| ATTACAAT | Polled |
| ATTACGAT | Horned |
| ATTATGAT | Horned |
| ATTATGTT | Horned |
| ATTGCAAT | Polled |
| ATTGCATT | Polled |
| ATTGCGAT | Horned |
| ATTGCGTT | Polled |
| GCCGCATT | Polled |
| GCCGCGTG | Polled |
| GCCGCGTT | Polled |
| GCTACAAT | Polled |
| GCTGCGAT | Horned |
| GCTGCGTT | Horned |
| GTTACGTT | Polled |
| GTTGCATT | Horned |
| GTTGCGTG | Horned |

TABLE 6

Observed six nucleotide-marker haplotypes to distinguish horned and polled in Charolais. Markers are ordered according to their positions in Btau3.0: 1013610-1731905-1872077-2214142-2332892-2816109

| Haplotype | Assoc. Phenotype | N |
|---|---|---|
| CAAATG | horned | 2 |
| CAATCT | horned | 2 |
| CAATTT | horned | 7 |
| GAAACG | horned | 2 |
| GAAACT | horned | 2 |
| GAAATG | horned | 4 |
| GAATCT | polled | 57 |
| GAGATT | horned | 1 |
| GAGTCT | horned | 1 |
| GAGTTG | horned | 4 |
| GAGTTT | horned | 14 |
| GGATCT | horned | 1 |
| GGATTG | horned | 1 |

TABLE 7

Observed eight-marker haplotypes to distinguish horned and polled in Shorthorn. Markers are ordered according to their positions in Btau3.0: 1731905-2101528-2128551-2214142-2288436-2332892-2333140-2816109.

| Haplotype | Assoc. Phenotype | N |
|---|---|---|
| ACTAGCGG | horn | 1 |
| ACTAGTGT | horn | 1 |
| ACTTACGT | horn | 3 |
| ATCTATGT | horn | 12 |
| ATTTACGT | horn | 2 |
| ATTTATGT | horn | 1 |
| ATTTGCAT | horn | 4 |
| ATTTGCAT | horn | 1 |
| ATTTGTGT | horn | 11 |
| ATTTGTGT | horn | 1 |
| GCTTGCGG | horn | 3 |
| GTTAGCGT | horn | 2 |
| ACTTACAT | horn | 2 |
| GCTTGCGT | horn | 1 |
| ATCTGCAT | inconsistent | 3 |
| ACTTGCGG | poll | 6 |
| ACTTGCGT | poll | 8 |
| ATTTACAT | poll | 20 |

TABLE 8

Observed four-marker haplotypes to distinguish horned and polled in Jersey. Markers are ordered according to their positions in Btau3.0: 1356048-2101528-2288436-2333140.

| Haplotype | Assoc. Phenotype | N |
|---|---|---|
| ACGG | horned | 9 |
| ACGG | horned | 1 |
| ACGG | horned | 1 |
| ACGG | horned | 14 |
| ATGG | horned | 2 |
| GCGG | horned | 2 |
| GTAA | polled | 1 |
| GTAG | polled | 2 |
| GTAA | polled | 12 |
| ATAG | horned | 4 |

TABLE 9

Observed six marker haplotypes to distinguish horned and polled in Holstein. Markers are ordered according to their positions in Btau3.0: 1352705-1356048-1731905-1872077-2288436-2640799

| Haplotype | Assoc. Phenotype |
|---|---|
| AAAGAA | horn |
| AAAGAT | poll |
| AAAGGA | horn |
| AAGAAA | horn |
| AAGAGA | horn |
| AGAAAA | horn |
| TAAAAA | horn |
| TAAAAT | poll |
| TAAAGA | horn |
| TAAGAA | horn |

TABLE 9-continued

Observed six marker haplotypes to distinguish horned and polled in Holstein. Markers are ordered according to their positions in Btau3.0: 1352705-1356048-1731905-1872077-2288436-2640799

| Haplotype | Assoc. Phenotype |
|---|---|
| TAGAAA | horn |
| TAGAGA | horn |
| TGAAAA | poll |
| TGAAAT | poll |
| TGAAGA | horn |
| TGAGAA | horn |
| TGGAAT | poll |

TABLE 10

Observed ten-marker haplotypes to distinguish horned and polled in Simmental. Markers are ordered according to their positions in Btau3.0: 1356048-1731905-1872077-1872200-2101528-2214142-2288436-2332892-2333140-650867.

| SEQ ID NO: | Haplotype | Assoc. Phenotype | N |
|---|---|---|---|
| 97 | AAATCTGCGT | poll | 29 |
| 98 | AAATTTGCAT | poll | 13 |
| 99 | AAGCTTATGT | horn | 13 |
| 100 | GAATTTACGT | horn | 11 |
| 101 | AAATTTATGT | horn | 10 |
| 102 | AAATTAGCGT | poll | 8 |
| 103 | GAATTAGCGT | poll | 8 |
| 104 | AGATTTATGT | horn | 6 |
| 105 | GAATTTGCGT | horn | 6 |
| 106 | GAGCTTATGT | horn | 6 |
| 107 | AAATTTACAA | poll | 5 |
| 108 | GAATCTGCGT | poll | 4 |
| 109 | AAATTTGTGT | horn | 3 |
| 110 | AAGCTTACAT | horn | 3 |
| 111 | GAATTTGCAT | horn | 3 |
| 112 | GAATTTGCGA | horn | 3 |
| 113 | AAATTTACAT | inconsistent | 2 |
| 114 | AAATTTGCGT | poll | 2 |
| 115 | AAGCTTGCGT | horn | 2 |
| 116 | AGATTTGCGT | horn | 2 |
| 117 | AGGCTAATAT | poll | 2 |

TABLE 10-continued

Observed ten-marker haplotypes to distinguish horned and polled in Simmental. Markers are ordered according to their positions in Btau3.0: 1356048-1731905-1872077-1872200-2101528-2214142-2288436-2332892-2333140-650867.

| SEQ ID NO: | Haplotype | Assoc. Phenotype | N |
|---|---|---|---|
| 118 | GAATTTATGT | horn | 2 |
| 119 | AAATCTACAT | horn | 1 |
| 120 | AAGCTTGCAT | poll | 1 |
| 121 | AAGTTAGCGT | poll | 1 |
| 122 | AGATTTGTGT | horn | 1 |
| 123 | GAATTAACAT | poll | 1 |
| 124 | GAATTTGTGT | horn | 1 |
| 125 | GGATCTACGT | poll | 1 |

Example 5

FIG. 48 shows a flowchart of the input of data and the output of results from the analysis and correlation of the data pertaining to the breeding, veterinarian histories and performance requirements of a group of animals such as from bovines. The flowchart illustrated in FIG. 48 further indicates the interactive flow of data from the computer-assisted device to a body of students learning the use of the method of the invention and the correlation of such interactive data to present an output as a pie-chart indicating the progress of the class. The flowchart further indicates modifications of the method of the invention in accordance with the information received from the students to advance the teaching process or optimize the method to satisfy the needs of the students.

Figure 49:
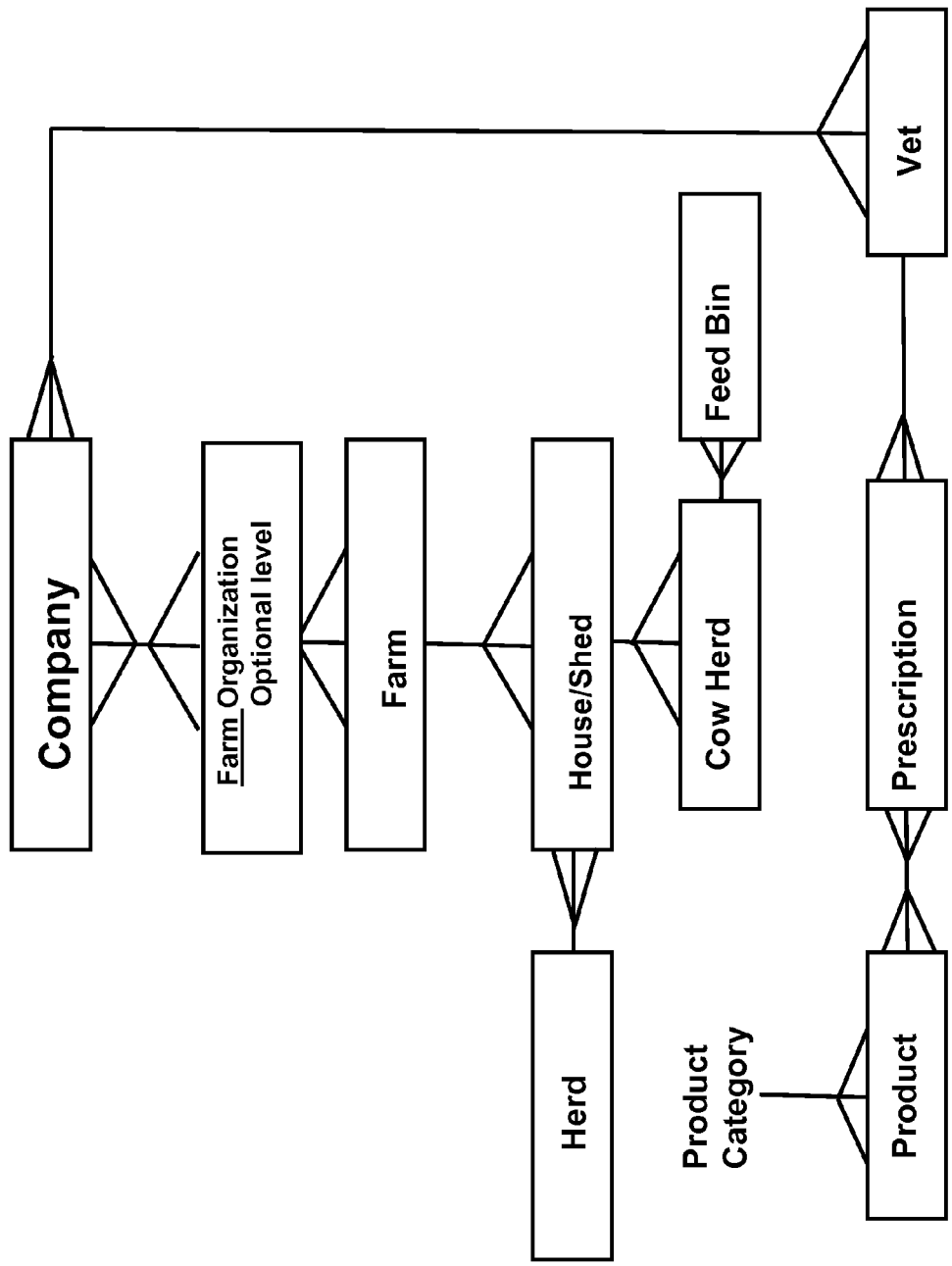
FIG. 49 illustrates potential relationships between the data elements to be entered into the system. Unidirectional arrows indicate, for example, that a barn is typically owned by only one farm, whereas a farm may own several barns. Similarly, a prescription may include veterinarian products.

FIG. 49 illustrates potential relationships between the data elements to be entered into the system. Unidirectional arrows indicate, for example, that a house or shed is typically owned by only one farm, whereas a farm may own several houses or sheds. Similarly, a prescription may include have several veterinarian products.

Figure 50A:
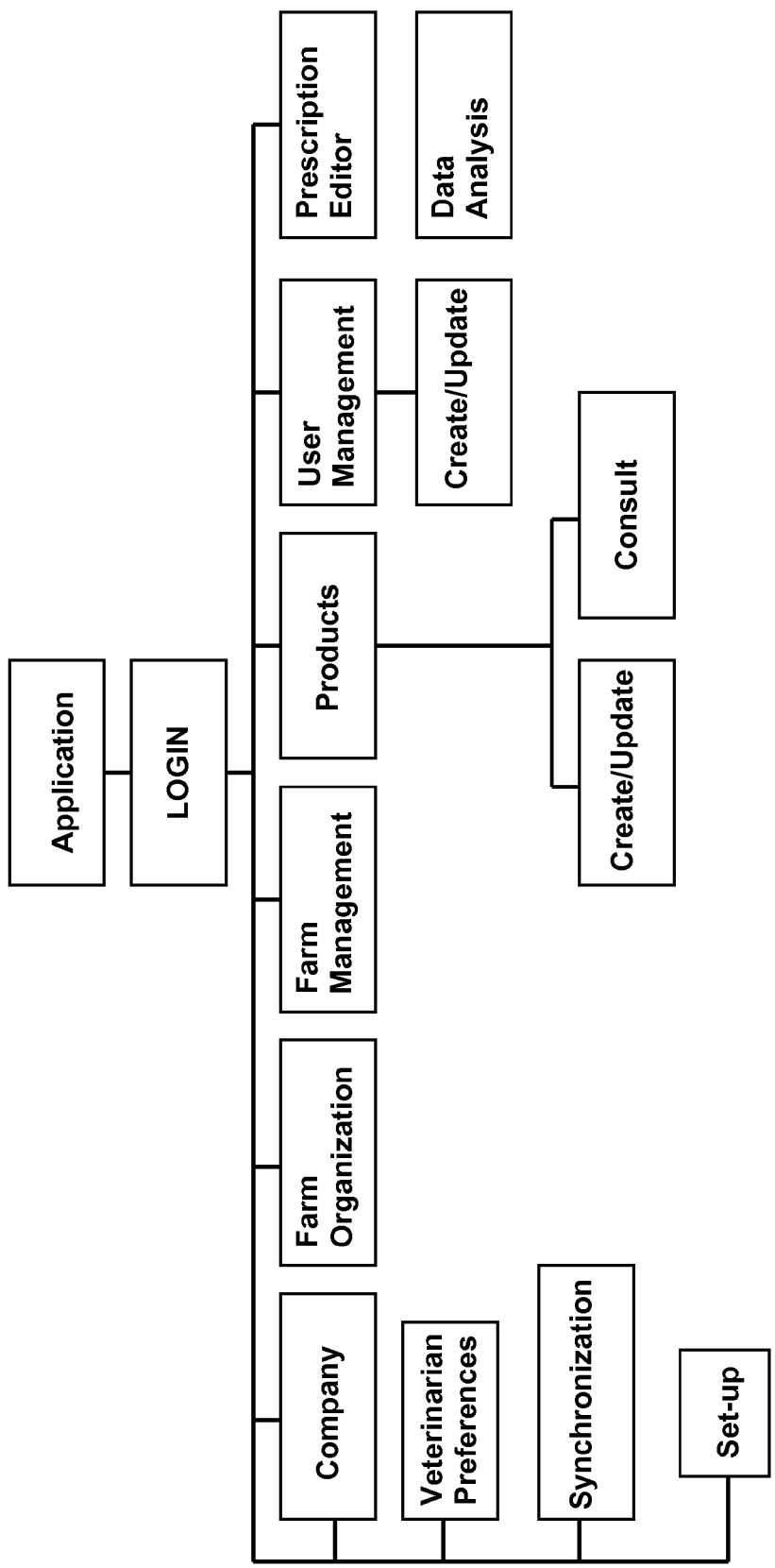
FIG. 50A illustrates the flow of events in the use of the portable computer-based system for data entry on the breeding and rearing of a herd of cows.
Figure 50B:
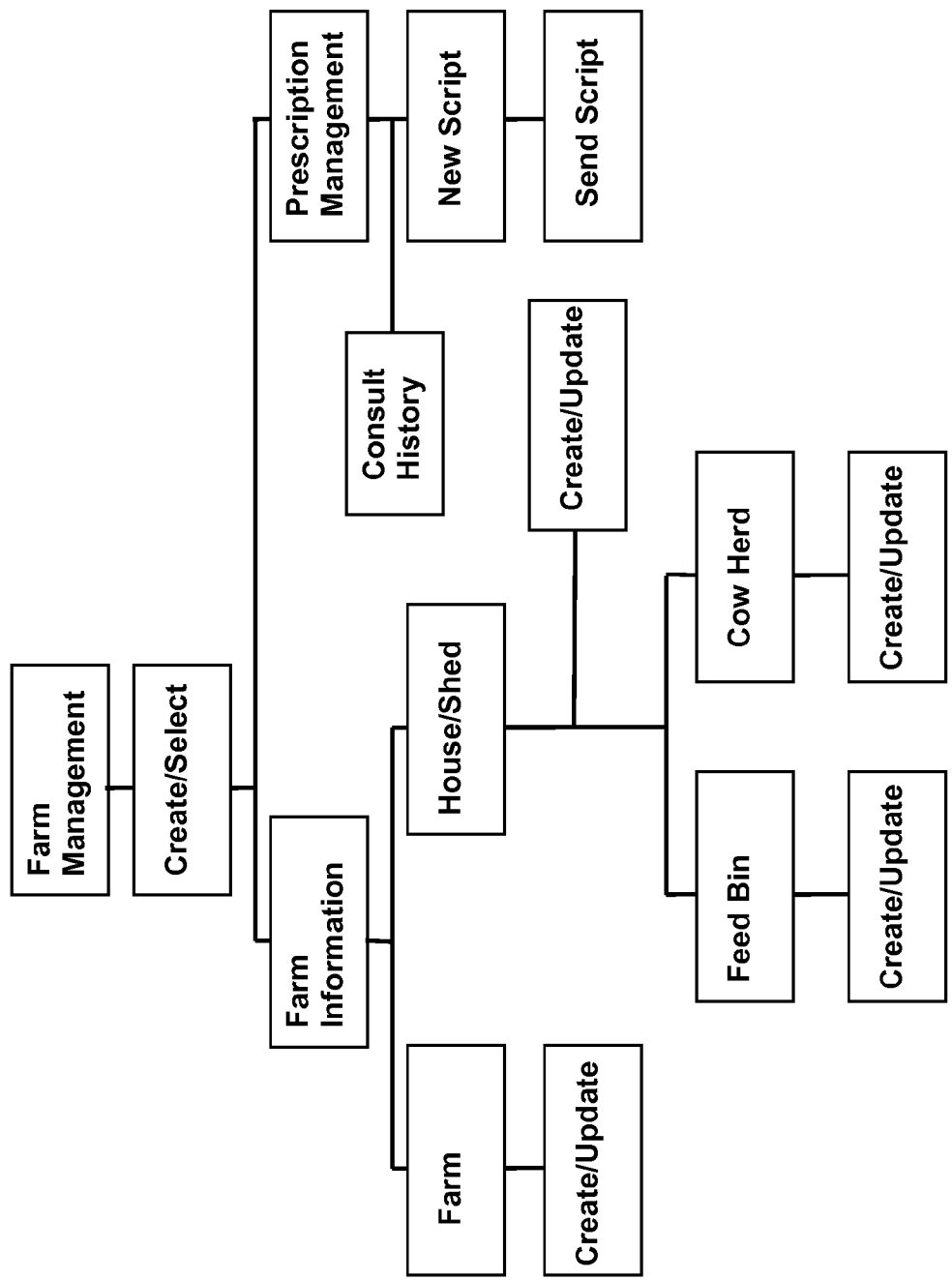
FIG. 50B illustrates the flow of events through the subroutines related to data entry concerning farm management.

FIG. 50A illustrates the flow of events in the use of the portable computer-based system for data entry on the breeding and rearing of a herd of cows. FIG. 50B illustrates the flow of events through the sub-routines related to data entry concerning farm management. FIG. 50C illustrates the flow of events through the sub-routines related to data entry concerning data specific to a company.

Figure 51:
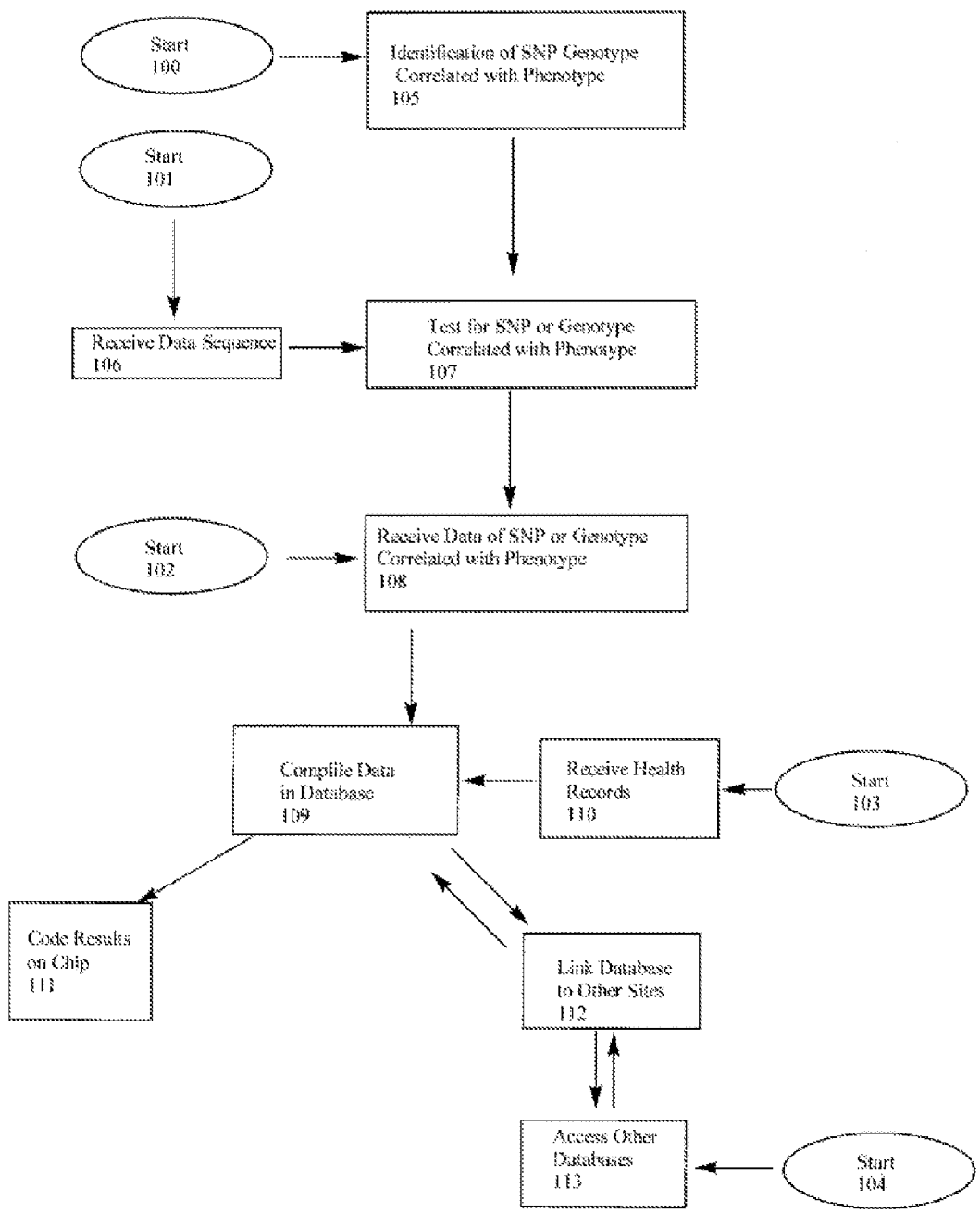
FIG. 51 illustrates a flow chart of the input of data and the output of results from the analysis and the correlation of the data pertaining to the breeding, veterinarian histories, and performance requirements of a group of animals.

FIG. 51 illustrates a flow chart of the input of data and the output of results from the analysis and correlation of the data pertaining to the breeding, veterinarian histories, and performance requirements of a group of animals.

The invention is further described by the following numbered paragraphs:

1. A method for sub-grouping animals according to genotype wherein the animals of each sub-group have similar polymorphism in Polled-associated gene(s) comprising:
(a) determining the genotype of each animal to be sub-grouped by determining the presence of single nucleotide polymorphisms in or near the Polled gene(s), and
(b) segregating individual animals into sub-groups wherein each animal in a sub-group has similar polymorphisms in the Polled gene(s).

2. A method for sub-grouping animals according to genotype wherein the animals of each sub-group have similar genotypes in the Polled gene(s) comprising:

(a) determining the genotype of each animal to be sub-grouped by determining the presence of single nucleotide polymorphisms of interest in or near the Polled gene(s), (b) segregating individual animals into sub-groups depending on whether the animals have, or do not have, the single nucleotide polymorphism(s) of interest in or near the Polled gene(s).

3. The method of paragraphs 1 or 2, wherein the single nucleotide polymorphism(s) of interest is selected from the group, wherein the single nucleotide polymorphism(s) of interest is selected from the group consisting of the nucleotide substitutions defined in SEQ ID NO 1 through SEQ ID NO 42 (FIG. 1 through FIG. 42).

4. A method for sub-grouping animals according to genotype wherein the animals of each sub-group have a similar genotype in the Polled gene(s) comprising:

(a) determining the genotype of each animal to be sub-grouped by determining the presence of a nucleotide substitutions defined in SEQ ID NO 1 through SEQ ID NO 42 (FIG. 1 through FIG. 42).

(b) segregating individual animals into sub-groups depending on whether the animals have, or do not have nucleotide substitution(s) defined as defined in SEQ ID NO 1 through SEQ ID NO 42 (FIG. 1 through FIG. 42).

5. A method for identifying an animal having a desirable phenotype as compared to the general population of animals of that breed, comprising determining the presence of a single nucleotide polymorphism(s) in the Polled gene(s) of the animal, wherein the polymorphism is selected from the group comprising the nucleotide substitutions defined in SEQ ID NO 1 through SEQ ID NO 42 (FIG. 1 through FIG. 42)

6. The method of any one of paragraphs 1 to 5 wherein the animal is a bovine.

7. The method of any one of paragraphs 1 to 6 wherein the Polled gene(s) are bovine Polled gene(s).

8. An interactive computer-assisted method for tracking the rearing of livestock bovines comprising, using a computer system comprising a programmed computer comprising a processor, a data storage system, an input device, an output device, and an interactive device, the steps of: (a) inputting into the programmed computer through the input device data comprising a breeding history of a bovine or herd of bovines, (b) inputting into the programmed computer through the input device data comprising a veterinary history of a bovine or herd of bovines, (c) correlating the veterinary data with the breeding history of the bovine or herd of bovines using the processor and the data storage system, and (d) outputting to the output device the breeding history and the veterinary history of the bovine or herd of bovines.

9. The method according to paragraph 8, wherein the computer system is an interactive system whereby modifications to the output of the computer-assisted method may be correlated according to the input from the interactive device.

10. The method according to paragraph 8 or 9, further comprising the steps of inputting into the programmed computer diagnostic data related to the health of the cow or herd of cows; and correlating the diagnostic data to the breeding and veterinary histories of the cow or herd of cows.

11. The method according to any one of paragraphs 8 to 10, wherein the veterinary data comprise a vaccination record for a cow or herd of cows.

12. The method according to any one of paragraphs 8 to 11 wherein the health data are selected from the group consisting of husbandry condition data, herd history, and food safety data.

13. The method according to any one of paragraphs 8 to 12, further comprising at least one further step selected from the group consisting of inputting into the programmed computer data related to the quality control of the bovine or herd of bovines and correlating the quality control data to the breeding and veterinary histories of the cow or herd of cows, inputting into the programmed computer performance parameters of the cow or herd of cows; and correlating the required performance parameters of the bovine or herd of bovines to a specific performance requirement of a customer, correlating the vaccine data to the performance parameters of the bovine or herd of bovines, correlating herd to the performance parameters of the bovine or herd of bovines, correlating the food safety data to the performance parameters of the bovine or herd of bovines, correlating the husbandry condition data to the performance parameters of the bovine or herd of bovines, inputting into the programmed computer data related to the nutritional data of the bovine or herd of bovines; and correlating the nutritional data to the performance parameters of the bovine or herd of bovines, and alerting to undesirable changes in the performance parameters of the bovine or herd of bovines.

14. The method according to any one of paragraphs 8 to 13, further comprising the steps of inputting into the programmed computer through the input device data comprising a genotype of a bovine; correlating a physical characteristic predicted by the genotype using the processor and the data storage system; and outputting to the output device the physical characteristic correlated to the genotype for a bovine or population of bovines thereby improving bovine production.

15. The computer-assisted method according to any one of paragraphs 8 to 14 for optimizing efficiency of feedlots for livestock comprising outputting to the output device the breeding and veterinary history of the bovine or herd of bovines, thereby optimizing efficiency for the bovine or herd of bovines.

16. A method of transmitting data comprising transmission of information from such methods according to any one of paragraphs 8 to 14, selected from the group consisting of telecommunication, telephone, video conference, mass communication, a presentation, a computer presentation, a POWERPOINT™ presentation, internet, email, and documentary communication.

17. An interactive computer system according to any one of paragraphs 8 to 14 for tracking breeding and welfare histories of cows comprising breeding and veterinarian data corresponding to a bovine or herd of bovines, and wherein the computer system is configured to allow the operator thereof to exchange data with the device or a remote database.

18. The interactive computer system according to paragraph 19, wherein the input and output devices are a personal digital assistant or a pocket computer.

19. A method of doing business for tracking breeding and welfare histories of livestock comprising breeding and veterinarian data corresponding to one or more livestock animals comprising providing to a user the computer system of paragraph 17.

20. A method of doing business for tracking breeding and welfare histories of livestock comprising breeding and veterinarian data corresponding to one or more livestock animals comprising providing to a user the computer system of paragraph 18.

21. The method of doing business according to paragraph 19, further comprising providing the animal owner or customer with sample collection equipment, such as swabs and tags useful for collecting samples from which genetic data may be obtained, and wherein the tags are optionally packaged in a container which is encoded with identifying indicia.

22. The method of doing business according any one of paragraphs 8 to 14, wherein the computer system further comprises a plurality of interactive devices and wherein the method further comprises the steps of a receiving data from the interactive devices, compiling the data, outputting the data to indicate the response of a student or class of students to a question relating to the operation of the computer-assisted method, and optionally modifying the operation of the computer-assisted method in accordance with the indication of the response.

23. The method of any one of paragraphs 6 to 22 wherein the data comprises presence or absence of one or more of a single nucleotide polymorphism(s) of interest in the Polled gene(s).

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (125 sequences)

SEQ ID NO: 1 - DNA, 501 bp, Bos taurus
  modified_base (33)..(82): a, c, g, t unknown or other
acccacggacatgtagaggccttgatatctccnnnnnnnnnnnnnnnnnnnnnnnnnnnnnnnnnnnnnnnnnnnnnnnnnntagaagctgtcctgggaaagggatctgcctggccaggagtggtttggtgtacaacctcggtgctcactgagcggactttggttttcttggaaaactaaaagacaagcctctgactgctaaccatgttatctgtataactggagatgatttcagtggtatttccctcttraaaaaagataaattgtgccacttgagtgcagctgtcactgattgggtctatgtgaacaggataaaagagttatgttccccagcagctctgtgataaattgttgaagagccacagcaataaacaagaaaagctgaccacaggaatgtcccagacagaaaggaaaaggccagcaaggaggctccctagggggctgtcatggtctctcggggaccatagtcagactctctgctgtggtgcagcccacacacca

SEQ ID NO: 2 - DNA, 501 bp, Bos taurus
gggctagcctgggaatgtaataacccctttataacactactcgcatgggtaaatacatccagattacttatagataattaacagaagaatttttagggctcagtccatttggaagtttaagactggaaagtgaagacactctgtatgatggggttaacataaaatgcttttatgtgtgttcatacaaagaaccaaggcaatatttttcattaattttccctggagaatagctgctttacaaagttgtgtcrgcttctgctctcagcaaagtgaatcaccaaacggatacatgtatcctcccttttttggatttcctcccgtttaagtcaccagcaagcacagaggagagttcgcagtgctggacagtgggttttcatcagttatctattctatagatagtatccatttttaaaaattaaactgactcatcattggacaaagaaaatcttccttcacagaaacccaactccacactaaaatgggatataaagaatttgtggc

SEQ ID NO: 3 - DNA, 501 bp, Bos taurus
ctggaaagtgaagacactctgtatgatggggttaacataaaatgcttttatgtgtgttcatacaaagaaccaaggcaatatttttcattaattttccctggagaatagctgctttacaaagttgtgtcagcttctgctctcagcaaagtgaatcaccaaacggatacatgtatcctcccttttttggatttcctcccgtttaagtcaccagcaagcacagaggagagttcgcagtgctggacagtgggttytcatcagttatctattctatagatagtatccatttttaaaaattaaactgactcatcattggacaaagaaaatcttccttcacagaaacccaactccacactaaaatgggatataaagaatttgtggcaattatggtacaaacacctaaacccagaaggcagaaagttggaacgtattgaatgcatgataccgtaatgataagaaatagttctaccatgaaataacacgtatttttctcttagccttaac

SEQ ID NO: 4 - DNA, 501 bp, Bos taurus
cactaatgtggaagttcatacagaaaagaaggaagtcaggaattaatttctaagcggatctgtcttactcctttggatatgagcgaagaaaccgatttgagctggtttaagcccgaagtgagttggttggggaggtagcctacgggtagaaagccatcttcagaagccagaccaggaaagaaagcctcagggcgggactaaactggaacttcgcgagcatggagtctctctgtctgtctgtctctctgctyctctctctcccctctacggcttttctctgagcctgggctagatggcatacagtcatccccacaacccaggcgattcttaagttacacttttctgtcctaacaatttataaagactaccaatctggcaacttccttccaaattcctaccagagagctgtttctttggctggactggggtcaggtagccccctcctgtgatctgccttggccagagaccatgtgacatgatatgattataaacttggctgcc

SEQ ID NO: 5 - DNA, 501 bp, Bos taurus
tgttttccaccgtgtcaggaatctgaactttggggttctctgggacataaaagatggatgccagcgggtgagaactaacttccgtttcagttcaaaatccattgctggcagcacccgtgagagggtctctgctgtgctcacatgggatagaaagacctagaatggcagttcgggaccagcactccagagccctgattcccaggacttcagtggacagagaaccccaaacatcgggagcctttccaactcawgggggaaggatgaaacctaatttcattttaccaggcaagttttagcattttgccagaattcttttcgagtttaaggcgtgtgaagaccaggataagtgaactgtgcttgaatcaggtggcacgtaggtttgaacggtgaggcatccagatggcttagaagcagtggtcgcttgaagcagttactgaggacagggatagtatccgagtcacctctgtgtcctcccagcctgaggttatgacaccttgagtg

SEQ ID NO: 6 - DNA, 501 bp, Bos taurus
tcacaacagttatttgtccccagatgtcagtagtcctgagattgaaaaagttcctggattcaaagcagagcaagtcatgagattacaggttttttcacctaccaagttggccttgacttttcagacctgatactcagcaccagcaaagaatcaggtacttccctggaggaagtgttatggcccctctggaagacagcaggtctggcagtgtgtatgtcagaggtcttgaaaatgtgtatcaacctggaggygggggtttggggagtcgcctcaggatcacccagggaatggatttgaaaaaactcataagccctcagagatccgggctgggggctaggttgggaggagctgagaacttgtgcaccattccaagaacataggtaggcacgcagtgcaggctgctgctcgtgggaacagcctgatcgtaccacttggggaatgggtacatgacttacggtcactcctaggacagagtgatgatcagccctccaaaatgatgtt

SEQ ID NO: 7 - DNA, 501 bp, Bos taurus
gacctgatactcagcaccagcaaagaatcaggtacttccctggaggaagtgttatggcccctctggaagacagcaggtctggcagtgtgtatgtcagaggtcttgaaaatgtgtatcaacctggaggcgggggtttggggagtcgcctcaggatcacccagggaatggatttgaaaaaactcataagccctcagagatccgggctgggggctaggttgggaggagctgagaacttgtgcaccattccaagwacataggtaggcacgcagtgcaggctgctgctcgtgggaacagcctgatcgtaccacttggggaatgggtacatgacttacggtcactcctaggacagagtgatgatcagccctccaaaatgatgttctaaaggatttttaccgatgtggagacagttcatgctacataaataaagcaggtacaaagctatatataatttcaaagaagttaaaaaaacccaaaccccaataaaaacccaatacacttaac

SEQ ID NO: 8 - DNA, 501 bp, Bos taurus
ccaagctccacaacaagaccccgcaatgagaagcccacgcaccacaactagagaaagccgtcacccagcaacaaagacccagcacagccaaaaatgaaataaaaacgaaaacaaaaaccgactagcctctgttctcaccaattcttgcctatcagataatgaacaagcaaacaaatatgcaaagtggtgataagtcgccatcagaagcaagagccaggcaaaaggacggtgagagtggaaggtctatcttyaggaagagttgccagggaaggcctctctgacgtggcgacatctgcacggagaccagcagcacacaaaggagcttgacgaccactgggaagccagacatttcaattttctcaacgctttccattaacaccccacaaacaaaaccccttcctctctcctaagcacaaatatttgcctttggcccatagctgaaaaattttacataaaccaccgcttatttaaacagacccacgaccacacgttgattcaata

SEQ ID NO: 9 - DNA, 501 bp, Bos taurus
  modified_base (289)..(363): a, c, g, t unknown or other
cctctggacacgccagtgcctcctgagcccagctattgtcctgccaggccacacatttccaagggcagtggctagccctcagtcaccctctctgggttagttgcccatccctggtcccatcagctatggcagggagaccggtggtatagagccccttggaagcatcattcttaggacagcggtggctgtcttgggtggattaagccagaggaaaattgagtgtgggaggccaactgcatgaacacaggagrgtgaacgtctaatgagctcagctctaattactgcttgnnnnnnnnnnnnnnnnnnnnnnnnnnnnnnnnnnnnnnnnnnnnnnnnnnnnnnnnnnnnnnnnnnnnnnnnnnntgagcagtgagaccattaccacgatcgttgaaagaaaccccctacccctgggcagtcaccttcctttgcttctccccagccctgggcaaccactaaatcttctgtctatgagtttgtctcttgtgccacatttcacat

SEQ ID NO: 10 - DNA, 501 bp, Bos taurus
atagcaaggaagaaatgggcagggaagagaaaagaagctttgggaaggaagacagctgctgctgctgctaagttgcttcagtcatgtccgactctgtgtgaccccacagacagcagcccaccaggctaccctgtccctgggattctccaggcaagaaaactggagtgggtgcaaggaagacaggggacctgacaattgattggaggcgaagcaaagaatggtgaagaggtcacgggcctctggcgtttcgyggccaagacacaagaaggacaatgtcactgagaactcaggaggcacaggcaggggacaggggtatgcaggggggccttgagaggaaaccatccgcattcattagagacactcggcatgcacctatacataaacgggagccatagggctgcaggtggtcgggaattcagaactgggtgggtctggggagacggcttagggctgcgggagtcagagacccagcactggtcactgaagtcacggcaggccggg

SEQ ID NO: 11 - DNA, 501 bp, Bos taurus
gttgacaaaagctcagagtcctgggtaggaaatgtgggaactagagctgagaagtcatctggggccagatcagggggcgtggagtctcagattaagagagctgtgttccgcttgtgtttgggggaaatgctgaacagaagattcatttgacaatggtgtgttcattagatcgaggggtaagaattaaagtaggaagaccaactaagcaataactcgggcaagaaacaaggaagcctgaacaaggataaatrgcaaggaagaaatgggcagggaagagaaaagaagctttgggaaggaagacagctgctgctgctgctaagttgcttcagtcatgtccgactctgtgtgaccccacagacagcagcccaccaggctaccctgtccctgggattctccaggcaagaaaactggagtgggtgcaaggaagacaggggacctgacaattgattggaggcgaagcaaagaatggtgaagaggtcacgggcctctggcgtttcgcgg

SEQ ID NO: 12 - DNA, 501 bp, Bos taurus
aggaattaagcccattcagcacaactactgagcctgtgctccagagcctgggagccgcaagcactgaagcctgcacaccctagaccccctggctacataagtagccactgcaatgggaagcctgcccaccacagctagagaatagctccagctgctcgtcacaactagggaaaaggccatgcagcaacaaagacccagtgtagccaaaaaataaaataaataaccattaaaaaaaaaaagagtattccatyaggaaacctcatctgaataaagaacaaacatatgtttacacctgagctaaaatatttaacactataaaaggactgcagccttttcagtttatcttattagctcacaatatatggcaaactcagtttatttctttgaggatagcaataatcatttttcataagcttattgatgtccattttgagtgaatttctttacagaaaataggattaatcataaccacaaactgtttccacgtttattgtgttggga

SEQ ID NO: 13 - DNA, 501 bp, Bos taurus
cctaaatacctcccaaaggatctgctttctaatgccatcatatgaggattaggttttaacatatgaattcttgggtggcacatttaactcattgcaaccccctcttcaacagagataagaaaagcaaccctttgtctataccagtaagttatcctcatattaaatattccactcatctatttcactgtcctgaaagccgcagatagcacgggcaacccacatcttcataaatgctcatgcttgcctacaakagaagacatcagtaaatctgaggtgaagatgcttgccttccatgtattaaaactccaggaacaggacagttaatactgcagactaaaatgggtgtgttgggacttctctggccatccagagatgactgagcacctccactgcagggcgcacgggttcgatccctggtcggagaactaagatcctgcaggctttgctttgcagccaaataaataaataaatgaaatgggtgtgttgcactggcaacttaaa

SEQ ID NO: 14 - DNA, 501 bp, Bos taurus
agtaaatctgaggtgaagatgcttgccttccatgtattaaaactccaggaacaggacagttaatactgcagactaaaatgggtgtgttgggacttctctggccatccagagatgactgagcacctccactgcagggcgcacgggttcgatccctggtcggagaactaagatcctgcaggctttgctttgcagccaaataaataaataaatgaaatgggtgtgttgcactggcaacttaaatcccatgagastgttgccatcagtgatgggattctcagaaatggtgacagttgttggtaatgctctcacaagagaatgtgatgttttttcaatttacatggttacccaaataggattcattgcatattcagttcagttcagtcgctcagtcgtgtctgattctttgcgaccccatgaactgcagcatgccaggcctccccgtccatcaccaactcccaagatccacccaaactcatgtcccttgagtcagtgatgccatcc

SEQ ID NO: 15 - DNA, 501 bp, Bos taurus
ctcctccatccatgggattttccaggcaagaacactggagtgggttgccatttccttctccaggagatcttcccgacccagggataaaacccgggtctcccgcattgtaggcagacactttactgtctgagccaccaggggagtccaagtttgaaagtctgactctaaagcccatctactctaacagtgcatgttcagtctatgtacaacttgcttatatttttgagattatcttccatcataagaattgstactacctatactttcattaagaaataaaaaatgtagtgcttaaaaaatggcagggcagggacacagacgcagacacagagaacagacttgtggacagagggggaaggaaagggtggggccaatgtacagagcagcgctgacacgcacgccattgttatgtacggcaggcgactgaagggaagttgctgtgcaacagggagctcagcccagcactctgcgacaacctggacgaggggctgggaggttcaa

SEQ ID NO: 16 - DNA, 501 bp, Bos taurus
tctcagtaatcattaagactgacaagaagaggcctttctacctctccgtctgcttaggacctcagggacaactgaagcctccagggcggcgagtacggtcaaaatgacagggccttttagggtagcctgcctggggcaatttcaggctttcaagagaacaaccatagtgatgagtctcattagctgcccgggggtcaagaagagaaagaccccaagatttcacacttgagaactttctgatacaaactgtwatgtgtgagtaggtgtggcagttttactgcttgtactgtgaaaaccaatttgatatttgaatttccccacctgtggacgtgggctgctcaactgggtgcctctaagtcactttcagacacactttcttctacttgctggatcattttctcccaggactgttgtggaaacaagaaacatagcaacaggtgagcatcacccccgggagggctcttcttctagccctttttccagctaatgaagcgaagcacc

SEQ ID NO: 17 - DNA, 501 bp, Bos taurus
agagaaagaccccaagatttcacacttgagaactttctgatacaaactgttatgtgtgagtaggtgtggcagttttactgcttgtactgtgaaaaccaatttgatatttgaatttccccacctgtggacgtgggctgctcaactgggtgcctctaagtcactttcagacacactttcttctacttgctggatcattttctcccaggactgttgtggaaacaagaaacatagcaacaggtgagcatcacccscgggagggctcttcttctagccctttttccagctaatgaagcgaagcacctgctgtttgcccatcgcagagccaggcactttgcagatagttgggttttcaagtacactcccagcactgcccagttagcctgctccctcactgagtgagttcactgtatcactgtcccggagaatcatttcacgtctccttatttctcccccaaactcctctgctccctcctttagctgatgacatttattaggaatgga

SEQ ID NO: 18 - DNA, 501 bp, Bos taurus; identical to SEQ ID NO: 1
  modified_base (33)..(82): a, c, g, t unknown or other

SEQ ID NO: 19 - DNA, 501 bp, Bos taurus
caaggtgtttttagggaaaggacagggaaattagacctcagcttcagttctgccacagaactgtgtggcgttgaggaggttactaaaccactctgagctacagtttcctcatctggagaacgggaataatgcctacttttcagactcttttgatcatcagatgaattaatatatatgaaagcagtttctgaagtgtagattcatatcattaatgaagtaggataatcttattttctgatttttgcaaggtratcttgagtaacatcaccttacaaaaatgacatcctggagacctttattcctcattgggtctttttctcctcatttgtcaaaggaagttgctagactagatttcatggttaaagatgtgtgtgtttatacatgtgcatgtaattttgaataaatcatttgcctgagtaacttataaataactttttcttgccaagcctatgatatttctatctgtgtttttaagatttgaagaccaattctcaaagactc

SEQ ID NO: 20 - DNA, 501 bp, Bos taurus
ctcagagcgacagtcataaattgagcctggagagagtattgtttgcttttctaacatgtttttcttctttccagtgcacatcagcctcgtgtttggtatttcgtatgttgcgcctggtaagagattttcttgacttaacaaaattttgtctaagggtgtgagtgggggagcaaccatttagaagtcaaaaaatgtgggaaattggatttctgagtccaaatctgttgccattttgtttgaatctttttccycaaatactttctctgtagaaggagaatttagccaattctgattttcacatttgtctcataaaactattacaggaaattaacactagagttaatttttaaaccccttaaaggaattgttcttgtggttgtcgtttagtcgctcagtcgttcgattcttttgtgaccccatggactgtagcccaccagactcttctgtgtatgggattctccaggcaagaatactggagtgggttgccacttctcccccagg

SEQ ID NO: 21 - DNA, 501 bp, Bos taurus
tggttgaagtgggaagagggtgagtgaggaccctagaggcaggagaaggttacaagaaaggcaccccacctctcccagcaacttggcattgcccttctctcgatccgccagggctgagccttgcagtacccttagggaccacccgaattcctcagaacacagtttggaaaccacttagtggctcttttccttctccttcatccatgcatcttccaaagactttccaagctcctcacttggaggggtattcraggtgctatgagacatgaaaatgcccacatcatcctttccgtcctcagtagagcagaggctgtctatctagaaaaggctggatcagagctttgttggagaattgctgaacaatgcaacgaaatgagtatgtctgggggtgggcaacagcaggaagtagttgttctgtgtgggtttgaggaacagcaactctctcagagatggagacgcttaaccagagaggagtaactctgggccctggaagaaacctac

SEQ ID NO: 22 - DNA, 501 bp, Bos taurus; identical to SEQ ID NO: 2

SEQ ID NO: 23 - DNA, 501 bp, Bos taurus; identical to SEQ ID NO: 3

SEQ ID NO: 24 - DNA, 501 bp, Bos taurus; identical to SEQ ID NO: 4

SEQ ID NO: 25 - DNA, 501 bp, Bos taurus
cccactctcatcctcagtgggccatcctaaagcagcatctttcctgagagaaagaagagggcttggtgggagcagccttttctgtccttttttttttccggccattgtatgcagcgtgtgagatctcagttccccgaccagcgattgaacccgcgcctcctgcactgggagcttggagtgttaaccactggacctccagggaagtctccagcctcttccatgctgagtcttgcacctttctccactgactycccccctttctaacgcacaccagttttgtggttaaccggttgcagtcccaaagtaattgctgttccatgaggaggtcacacctccaggcatggagggcctgagagaagtgtaggtaattacaggttcctgggaatacttgaaaaacttgttggaaagacagcagtgtgctagcaaagacatttagccaacggtcagggatgaaattttggaaaattctgcactgccaccacaatgcagtaattcattcaa

SEQ ID NO: 26 - DNA, 501 bp, Bos taurus; identical to SEQ ID NO: 5

SEQ ID NO: 27 - DNA, 501 bp, Bos taurus; identical to SEQ ID NO: 6

SEQ ID NO: 28 - DNA, 501 bp, Bos taurus; identical to SEQ ID NO: 7

SEQ ID NO: 29 - DNA, 501 bp, Bos taurus; identical to SEQ ID NO: 8

SEQ ID NO: 30 - DNA, 501 bp, Bos taurus; identical to SEQ ID NO: 9
  modified_base (289)..(363): a, c, g, t unknown or other

SEQ ID NO: 31 - DNA, 501 bp, Bos taurus; identical to SEQ ID NO: 10

SEQ ID NO: 32 - DNA, 501 bp, Bos taurus; identical to SEQ ID NO: 11

SEQ ID NO: 33 - DNA, 501 bp, Bos taurus; identical to SEQ ID NO: 12

SEQ ID NO: 34 - DNA, 501 bp, Bos taurus
tgtgagtgtccaagagtctgcagtggatgcacgggaagacactggcctgccacgggtcaggggcactgaatacaagagttccaggagccatggtgtgctggcctacgtccttttgaaggaggttgccattacccctaccgtagtttggcctcacagggagggaacacagctccatccatcaacagaaaactggacatctctgttgcttaccctcaaaggacctaaacagcaacccaggctttttcagagtwtgattacccagaagagctaagaacagactggatgtgagtttttgttctattttcagaaccaagcactctgcaccatcacaaattgctgatgagcacaagtaattttagttcagatctctaccagtgaattttctttctttggacatcacaaatattgcattagtatccaaaaaggactttgaaaacatccttggagctctttgaagtctgtgtgagggtcttgaatatccctatgactcatgagcaaaag

SEQ ID NO: 35 - DNA, 501 bp, Bos taurus
ttgaagtgaattgcaaaccaaacaagagaacaaactgcagtcatttcctggatctgaaaccaaatcttaatatgaactgtttactgaaatgtgaaccagctaaagtttgagagtaatttccaaacacacctgaggatttggtctaatcacgtaaccgaacccatatatatttaaaagcttttgaacagacttggaaactcacattgctaaacaaatctcagaacaaactcaaatgaaactaatagttcttyacagtgagctgactaaggaacacacaatagaaatgtgatgatcgaccttcttttttccgagtcaacattataatgagttgagttttaacacaattcagtctgcaattatttttccaagagggactatacgatccttttgataggtgtgtattgtgtgcaggaggaggaaggaggaagttagggggtcgggattataatggacaaggaaaggactcagaggcgatgaagcgaagtgtgtccttagagacgg

SEQ ID NO: 36 - DNA, 501 bp, Bos taurus
cttcaaacgtccctattgctaattttctcctctctctttctaccatatgctgtccctcccgttcagaacttaatgaacaacgtgcctcagtctgctggtccccattctgagcccctttcacccacttcatgccagatgactgctctgcaaattatttggccacagaaagtttatccacccaacatctagtcttgtcttgaggatggtgttccactaagcacacacagggaaatgctgctttaaacagtgcwggatatgctttgttcattcttacctgcatttcctttttaagaatttaaatatttatttagttatttattttggctgtgctgggttgttgttgctgagcgggtgggggctactgtcgttacggtgcacaggcttctcattgcagaaagcagaccccagggcactcaggcttcggtggttgcagcgagtgggttccatagttgtggcacattgacttggttaccctgcagcacgtggaatcttcctgggtca

SEQ ID NO: 37 - DNA, 501 bp, Bos taurus
gtgcattgaaggttctcaaacaggttagttcccctaatccccttttcctctgccgccagactacctctcctcccggcttcctggcttctgttacatcaccaccatcgtccggctttccacgctgcgtcttggcgtctccccttcaaacgtccctattgctaattttctcctctctctttctaccatatgctgtccctcccgttcagaacttaatgaacaacgtgcctcagtctgctggtccccattctgakcccctttcacccacttcatgccagatgactgctctgcaaattatttggccacagaaagtttatccacccaacatctagtcttgtcttgaggatggtgttccactaagcacacacagggaaatgctgctttaaacagtgctggatatgctttgttcattcttacctgcatttcctttttaagaatttaaatatttatttagttatttattttggctgtgctgggttgttgttgctgagcgggtgggggcta

SEQ ID NO: 38 - DNA, 501 bp, Bos taurus
atgcatgcatgctaaggcgcttcagccgtgtctgactttgtgcgaccctacagacagcaggccaccagcctcctctgtccacgggattctctaggcaacaaaactggagtgggttgccatttccttctccaaggtggctgtctacaagccaggaaaagaaacctcagtggaacttgaccacgctggcatcctgatccagacttccagcctccagaactgtgagaaaattaacttctggtggttaaaccacsccttcgggttatggtagtcaagctaagacacttgcttataggtgacctagaagtctcacctttaaaccaataaagcatgtcagaagacactgtgcagagatcaaatgtggctgctcaggtgggttaaattcaagaaggcatcagggacttccctggcagttcagtggttgagattttgccattcaatgcacggggtccaggttcagcccctggttggggaggtaagatcccacagggctcatagccaaga

SEQ ID NO: 39 - DNA, 501 bp, Bos taurus
ctgccatatcactaaacaaaggatgtcgcagacatcagtaattgcagccatcataaatggtgagctagtgagccctgagggaactcaggaaggaaagaatagctgccatctagtagccatcagaccacagccactccctgcagtgagccctgaggaccctcaagatgtgaaaatacaggatcccggcccccccgagactggaagtgcttatcaaaggagtgagttcagtgaggccagactcttgctcttcycatacaccgcaaggtgctaaattccttaacttgggacagctggttttctttaatttataataatcttttgacgttcagactacctgcctttgtaggtagtcacatacttctacataacctagctctcctcctcacctccctggagcagttccttcagggttatttgatatgtttcctcctgggcttgaagtcctaaaaattcctgccgattaaaacataactctcaacttttaagttgtgaacatttttt

SEQ ID NO: 40 - DNA, 501 bp, Bos taurus; identical to SEQ ID NO: 13

SEQ ID NO: 41 - DNA, 501 bp, Bos taurus; identical to SEQ ID NO: 14

SEQ ID NO: 42 - DNA, 501 bp, Bos taurus
ttaatacggggaagaattttactagatgttttaaattttggagttgcctgagtataaatgcctctagacagctccccaaaccatgctttatagactgctaaagcagttctttttttttttttttttcttatttcttggtcacagtgagtttctctcattgagttaaatacatatggtttggaatacagttaagtcccctacatacaaatgagttccattttgagagtgcgttcgtaaagccaattttttckcaagtccaacaaagttagcctaggtacctactcaactaacacagtcgtgcatataggactgtactatgacaggtttataatacttttcacccaaataatacatgaaaaacaagcaaagtataaagaaaccttaaaaaatatatttatttattcatttgtctgcactgggtctttagttgtagcgtgtgaactcttgctgcctgtgggatctagttccctgaccaggatttgaaaccaggggacctgcatt

SEQ ID NO: 43 - DNA, 3000000 bp, Bos taurus (residues 1-1,500,000 of 3,000,000)
  modified_base (3268)..(3767): a, c, g, t unknown or other
  modified_base (179664)..(179713): a, c, g, t unknown or other
  modified_base (194312)..(194640): a, c, g, t unknown or other
  modified_base (195971)..(196020): a, c, g, t unknown or other
  modified_base (296357)..(296610): a, c, g, t unknown or other
  modified_base (324054)..(324103): a, c, g, t unknown or other
  modified_base (564168)..(574167): a, c, g, t unknown or other
  modified_base (577234)..(577283): a, c, g, t unknown or other
  modified_base (842726)..(843408): a, c, g, t unknown or other
  modified_base (848893)..(849548): a, c, g, t unknown or other
  modified_base (1004164)..(1004213): a, c, g, t unknown or other
  modified_base (1035786)..(1045785): a, c, g, t unknown or other
  modified_base (1474297)..(1474346): a, c, g, t unknown or other
  modified_base (1565394)..(1565890): a, c, g, t unknown or other
  modified_base (1605625)..(1605674): a, c, g, t unknown or other
  modified_base (1649773)..(1649822): a, c, g, t unknown or other
  modified_base (2484044)..(2484093): a, c, g, t unknown or other
  modified_base (2510646)..(2510695): a, c, g, t unknown or other
  modified_base (2554495)..(2554622): a, c, g, t unknown or other
  modified_base (2608163)..(2608212): a, c, g, t unknown or other
  modified_base (2613886)..(2613935): a, c, g, t unknown or other
  modified_base (2630148)..(2630148): a, c, g, t unknown or other
  modified_base (2630151)..(2630151): a, c, g, t unknown or other
  modified_base (2630165)..(2630165): a, c, g, t unknown or other
  modified_base (2630167)..(2630167): a, c, g, t unknown or other
  modified_base (2630174)..(2630174): a, c, g, t unknown or other
  modified_base (2630188)..(2630188): a, c, g, t unknown or other
  modified_base (2630190)..(2630190): a, c, g, t unknown or other
  modified_base (2630192)..(2630192): a, c, g, t unknown or other
  modified_base (2630195)..(2630195): a, c, g, t unknown or other
  modified_base (2630314)..(2630314): a, c, g, t unknown or other
  modified_base (2630340)..(2630340): a, c, g, t unknown or other
  modified_base (2630349)..(2630349): a, c, g, t unknown or other
  modified_base (2630357)..(2630359): a, c, g, t unknown or other
  modified_base (2630362)..(2630362): a, c, g, t unknown or other
  modified_base (2630366)..(2630369): a, c, g, t unknown or other
  modified_base (2630374)..(2630374): a, c, g, t unknown or other
  modified_base (2630379)..(2630379): a, c, g, t unknown or other
  modified_base (2630389)..(2630389): a, c, g, t unknown or other
  modified_base (2630391)..(2630393): a, c, g, t unknown or other
  modified_base (2630405)..(2630406): a, c, g, t unknown or other
  modified_base (2630433)..(2630433): a, c, g, t unknown or other
  modified_base (2630436)..(2630437): a, c, g, t unknown or other
  modified_base (2630445)..(2630445): a, c, g, t unknown or other
  modified_base (2630453)..(2630453): a, c, g, t unknown or other
  modified_base (2630460)..(2630460): a, c, g, t unknown or other
  modified_base (2630463)..(2630463): a, c, g, t unknown or other
  modified_base (2630468)..(2630469): a, c, g, t unknown or other
  modified_base (2630481)..(2630482): a, c, g, t unknown or other
  modified_base (2630485)..(2630486): a, c, g, t unknown or other
  modified_base (2630525)..(2630525): a, c, g, t unknown or other
  modified_base (2630527)..(2630529): a, c, g, t unknown or other
  modified_base (2630535)..(2630539): a, c, g, t unknown or other
  modified_base (2630541)..(2630541): a, c, g, t unknown or other
  modified_base (2630543)..(2630543): a, c, g, t unknown or other
  modified_base (2630546)..(2630547): a, c, g, t unknown or other
  modified_base (2630550)..(2630552): a, c, g, t unknown or other
  modified_base (2630563)..(2630564): a, c, g, t unknown or other
  modified_base (2630569)..(2630569): a, c, g, t unknown or other
  modified_base (2630571)..(2630573): a, c, g, t unknown or other
  modified_base (2630577)..(2630579): a, c, g, t unknown or other
  modified_base (2630583)..(2630583): a, c, g, t unknown or other
  modified_base (2630586)..(2630588): a, c, g, t unknown or other
  modified_base (2630594)..(2630594): a, c, g, t unknown or other
  modified_base (2630596)..(2630596): a, c, g, t unknown or other
  modified_base (2630598)..(2630598): a, c, g, t unknown or other
  modified_base (2630601)..(2630602): a, c, g, t unknown or other
  modified_base (2630604)..(2630605): a, c, g, t unknown or other
  modified_base (2630607)..(2630609): a, c, g, t unknown or other
  modified_base (2630612)..(2630617): a, c, g, t unknown or other
  modified_base (2630621)..(2630622): a, c, g, t unknown or other
  modified_base (2630624)..(2630624): a, c, g, t unknown or other
  modified_base (2630638)..(2630639): a, c, g, t unknown or other
  modified_base (2630641)..(2630641): a, c, g, t unknown or other
  modified_base (2630644)..(2630644): a, c, g, t unknown or other
  modified_base (2630646)..(2630650): a, c, g, t unknown or other
  modified_base (2630653)..(2630655): a, c, g, t unknown or other
  modified_base (2630657)..(2630657): a, c, g, t unknown or other
  modified_base (2630659)..(2630660): a, c, g, t unknown or other
  modified_base (2630663)..(2630666): a, c, g, t unknown or other
  modified_base (2663609)..(2664095): a, c, g, t unknown or other
  modified_base (2684778)..(2684827): a, c, g, t unknown or other
  modified_base (2731473)..(2733317): a, c, g, t unknown or other
  modified_base (2737123)..(2737172): a, c, g, t unknown or other
  modified_base (2813564)..(2813613): a, c, g, t unknown or other
  modified_base (2884420)..(2884420): a, c, g, t unknown or other
  modified_base (2884531)..(2884580): a, c, g, t unknown or other
  modified_base (2916466)..(2916515): a, c, g, t unknown or other
  modified_base (2930067)..(2930116): a, c, g, t unknown or other
  modified_base (2937958)..(2968019): a, c, g, t unknown or other
  modified_base (2998669)..(2998916): a, c, g, t unknown or other
taccccactcacacttatggatagatcaactaaacagaaaattaacaaggaaaaaaaaaaaaaaaaaaacatgtatctataaagctcactaaagcaaagcacagtaaaatgaggtatggcaataaaaggcgttaaatttatcaaaaaaaaaaaaaaaaagtgctgaaaaattaaaaaaaaaaaaaagaaaaaaatatagagataaaattaaatttttgtatttattcttgccgttgaaaattatgggcaacttttcattttttcaaatttaatattgtgttactcaaaaataccctaaagttgatctctgtttaaatctagaacactttttgttaagtttatgtcgatatgtcttagctcttttttttaattagacatgatattttctttcatcacattttcaatatgtaggagagctagtgatatttgtgtaataattttgtactcggctaacttactgaatttatttacaataattttttttacctgatttcttggattaaacaaataaaataatatttaaaaaaaaaaaaaaaaaaaaaacaaaattaaaaacgtggcccacaataccatgaaatactactactcagcaataaaaaaagaatgaacataggcacaataacctggttgatctcaaaggaataatgctaattttaaaagtcaaccacatagtcttatgtactgtatgactccacttacacaacgtacttgaaatgacaaaaaataaagatggagaaaagcctagagttttccaagagttcaaggaggatggggaagtctagtgattttggctataaaaaggtagctttgtgatgtgaatattctgtatcctgccagtggcggtggttgcccaaatctacaaatgtgataaaaattgcagagaactaaatacacagataggtacgcacatgagtgcatgtaaaactgatgaaatctgaattagttctgtaaattatgtcaatgtcagtttcctgactgtgatattgtactattattatacaacagttatgttatgctttgggggaaactgagtgaaaaagccatggaatcactgtattttgcacaactgcatgtgaatctacagttgtctcaaaaaggtttaaaaaataaaaaatgctaagagaattccctgaggctcctataattaaattattctgcctttggacttttcttattaaaaaggacacctatgaaaaatcttcaaattaaaaaagtggattggtaaaaatacatcttaaagttattgaaaatttctaacgaggtggatgaaactggagcctattatacagagcgaagtaagccagaaagaaaaacaccaatatagtatactaacgcatatatatggaattcagaaagatgataacaataaccctgtatacgagacagcaaaagagacactgatgtatagaacagtcttttggactctgtgggagagggaggggggatgatttgggagaatggcattaaaacatgtataatattgtataagaaatgaatcgccagtccaggttcgatgcagaatacaggaagcttggggctggtgcactgggatgacccagagggatgatatggggagggaggtgggagggcggttcaggatggggaacacgtgtacacccatggcagatgcatgttgatgtatggcaaaatcaatacaatattgtaaagtaaaaataataatagtaataaaataaaaaaaaaacaaataaagctgctatgaatattaaaaaaaaaaaatatatatatataagtgtagaagtgatagacaaatagatgactttgtcaactatatttttcttttaaaaagaatggagtaaaatcaggcattcattgacagtacttgcaatacacagactgagttttgttagctattgttgacttttctgatttccggtcaccaaatccaaaaatagcttgtcctagacttctgacatatatcacccaggtgttatctaagatcaattctgcttgggaagttcacacacacacacacacacacacacacacactaaataaataaagtcagccagaaattaggaggaaatgggagcaggaaacagattttgtttgtagatatctttcttgctcttcccacctgatttacttttaatgccagatatttcttctttggtcttcacttccccaagttatttaccagattctaagccagagttgtgtaagtcatcaggagagaaaatgctgactactaaagtttacctgagcagcatcaaccaggctgaagcaatgtataccgtggtcctgtgaatattctagagagtctggcatttgtcttagtgctgtttgctggataacttctattcccttgctgctgtgatggtctacattattaaacattcacccttttgtttacaagtttttcatcgcatctatgacagtggcaaaaaatctctgtatgtccctgtctcctgcaagtccctcattcaagcagtcatagacaggctggtgccgtgaaatcctcaaagcccctgctgccaacatcacattgacaataataaaatgtttacatcactgttgaaaaagaggaggaactgtgatgttagtttcaaaaaaaaaaaaaaaaaatcactgagctaattgatcaactttcaattggtagaatttaaaacgtctactctggtaaaaacagggttttccaaactgctggagctgaagaatcaattgcaggctgataccgctttaaaattcaataaaataaatgattagaaaagcaaagagaaaaaagttaaagatgtaaaaatacagcctcagaatattattactaatattttttaatgtgaaccattcttaagtctttattgaatttgttacaatattgcttctgttttatgttttggtttttagactgcaaggcatgtgggtcttacctccccaaacaggtaaccccttcattgtaactccccaacttgtaacccctacattgagaggtgaagtctcaaccacagaccgtcagtccccagttattactaaattagcatagaattactctatcaaactgccataaaaattctaaacacttagctctcaatttctgtactaatttcagtataaatatttcataagccagcattttgagtaacactgaactaaaggacattctgtcatctggtcacccttcatcacttctttaaacctttttgatactcacatttagaccactcctctccactttctttcctctactgctgctgttggcaaagaaagacaattagaaaaaagcccccaagtctacataatcctctacatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaaaaacatcaattccaattctatataccaaattcaagaattcccatcagagatagcaaaaattaagtaagaattatacaaatgagaaaaatgagtggtctagagacaaaacttttaaaaaaagaaaacatatttatatctaagacaaaaaactatatcaattttttatactactcaatagtgtcaagattttaaatattccaaaattaacctataggtttaatgtgactagagtaaaatcataacaggatccatttttaatactgaggaaataatttaaaccccatctgctaaaatatttggtaacatctttgaaatctttccaaaaagatagtaaaccatagatttaaaacaagttgtacacttatggtaattaaaacattgctttacttttatatattgatgagcatacagattattgcaacagataaggtgactgaaaagaaattatatttgcatgtatgataaaagaagcatcacaagccaaggaatactgaaaggatcattcaataaatgggccttgggggagtaggattcatgaatttcttcagtttttaccatgcaacataattcacttctgatgaatcaaaaaattgacttagtaaagaagatcagagaaaactgatatgagtacttatccatttttgaagagagactgattttctagttaaacaagcataaaaagaggaaataatcctatatttaactcaataaaattaaaactctttcatgtgaaaaagttaataagatctagaaggtaaataaaagattgggctcaaatttacaaagaggtaataaacagataggtgatatctttataaacctcgctagtgttttaatttccttttgtttagtaactactgagatcagcactttcttacatgtttacttaatagctgtagttctaccctctgtctcacctgtttgtatcactttaccatgtgtctgttagagagtcttaatatttttctcatcatttcacatttgggaaaaagatttttaataaataaagcaaaacagataatgcttttaacgcacagaattagacaaacaccaagccccctagttatcaaagaaatgtaagccaaagctatagtgaaaaatgtttacttgctaaattagcaaactttttttaaaagatgatcccaaaaactgacttagataaactggaattttttcctatttgagtttggtaacagtggaagtttgaaattatgatttggagagcaacttataattataggcactatttataaattattataaaaatattaatgatagtaagcttatgttctaaaacaagtaaacaaacaattctaaaatatgggaaaagctatttaaaatttttctaaatagcctgtagatccagcagcccaggaatgagaaagcaaattgcagcactcatacagggaactcagtactgtcattaaaatgatgattatgaagactgcataacagcatggaaatacttatgatgattttatcataggaaaacacaaaagcaaaatacaaaatgatgagaaaagtagcaaaagggagggggcgaggaaagaaatgcactaagtaaaaaacttagtcattttttaaagagaattaaaatgaagtccaattcctttgagttacaaatttacaatcactactcagtaattaaaactattcagttatagtgaactgattccaccccattcctcattcaacaataagacaccccttactcccaccctaggtggggctggaacttgaggcctggggaggaagggcttctcatctctgtttccttctccccctccctagattggaaccctggaatgagactccttggctgttggcttctcctcaccctctgaagcggtcctcttaggcagaatttctttttaatagatttgatttcttagagaagttttagacacataacacaattgagcggaagacacagagatttcccacttactccctgatcccacatttgcataacatcccctaggtcagcatccctcaccagatggtgcatttgttacaactgatggtcttgcattgacacgtcatcatcacccagagcccacagcttacttttggtggtacccatcctaagggtctgggcaaacatataacgataaatgtccatcattataatatcacacagagtagtttcactgccctgaaactcttttgtgctccacctattcacccctgagtcctaattagatttttttcttcttcttcttcttttttggccacgctgtacacaaggcttgcagaatcttagttcccctacccgggattgaacctggaccacagcagtgaaagcacagagttgtaatcgttggacccctggggaactgccaaattaggcagaatttcttttttgtggtccgcaggaaatgcatcctcatcgttcgtccgtggagattgtagtaaccaagagtggccttccactccctctgccttgctcttggacttgaagtatgaatggaaggaacccaccaagagcaccctgagctgctggaagcccacccttcctgcctggagaaaaggcagcagcaccccactccttccgaggaggctggagctacgcacacaatgtagctcctctctccagagagactgtgttacttttctaactggagtgtttaatttgcagtgttgtgttggtttctgccacacaacaccatgaagcaggcatggatgtgcatatgttccttcccccatgagcttccctcccttgcacccccgtcacatccctctaggtcatcacagagcaccaggctgagctccctgtgtgatacagcaacttcccactagctgtctgtttcacacctgatagtgtttatatgtcaatgctatgctctcaattcgtcccttcttcaaagactctccattcttttgaattgaatgaatggtcaaggggtttgagagctgtggataggattcttggaccaccactccgagtattcctctgtaatcgggtcctttaattttaattcagtcgtgtccaactctttactaccccatggactgcagccctccaggctcttcggtccctgaggattctccaagcaagaacactggagtgggttgccatgccttcctccagggaatcttcccaacccagggatcgaaccctggtctcccgcattgcaggtggattctttactgactgagccaccagggaagcccctttaattaacaattttaataagctgtctcaagtataaagagcacagagaagcttgataggtcctaaatgtcgcttcagcttatttaggtgattaaaaaataaatatataaataatacaattaaaaagaaaaataaccagaaattgaaacttcgatatcttctggaacccctattttaatatttttatgccttggtcagtcctccctgagcttctattccttcctctgaaattggaataattaataatagctcttttccttcttcaacagtgtgttatcataaagagttaattgtttactacaaacatatcaacatgagctagtcttattataacaattggatatttcataaagagaaatattctggtgtattctgttttcttcttaatacgtgtgaattgctatgctcttctaagtggtggaatgatcagtagggaaataatcagaagtgaatacctaagtcaaaatttaccattacatctgatgcattgaggcttatcagaatatccaccaagcattaacaaaaatacaaaacaaaacaaattacctgttagaatctgaaggaaaaaaaaagaaaatttgtgagagataggttttgttttgctttgttttttcttcttttttaaaccaaaattagcaaaactaagatgtaacacatctggaaacaaaagcacatcaaagcttttcttttaatgagcacaaaagacatattgctgaggttagatactttaaaacgagtgaaatgagtttagtattgaaagaagctttttgttgaagattactgcttttattcagattcagatgaaattgtttatttttgttagacaatgaatttcttccttaagagtaatttcgctgtaaagtaatttttatctgtggcaatttatatctaatgttaggagagaatgataatagagagaattcattctaggtttttctggggtggtcacctcaaatggaagtcatgtccgactctttgcgaccccatggaccacacagtccatggaattctccaggccagaatactggtgtgggtagccttgcccttctccaggggatctttccaacccagggatagaacccaggtctcccacactgcaggcggattctttaccaactgagctatcagggaaacccagtaattttgaaatgggagttaaataacaatagggtaatgaagcatgatagttcaatggaacacggaaatgtttacattggtggttttgacagaattatacaattttaatgtaagaagcctttcaaaactgtcctcgtgtcttgcacatgaggaaactgaatgatgaatatcagaacaagaggtaaggtctcttcattcctggcccatcacctctgtgtgtatgttttacacaagatccttcaactcttaggttttgttatgaatcatattgagaaatactggttggaactgtcaacctgagacctgactgggccgttgtaactcccttaagaatcaagagagaggaaaaaggggagtgaagctgccggccccttccccctgctgactcactccccagagcgacaccgctcacaaggcctccacctttcaccgctgtgggagtcagggctcaaacttcagccgtgagtgaggggactccatattcccggcaaggcgtagcagtaactgctcctaccgtcgcagccacctcattgctaggagggcgtcactgcctgctccccgcccctcacccactgtatgccacccaccttttctatatgtaagcatgtaggcctcggccccgtgctttggaattgcccaaacacgggtatccagcttctccacagaaaaaacaacctcagtttctcattagtgctcccaccgccatttcccaccccaacgttgcgatttccacctcacaggggatcacggtgattgctatcctacccacggactgcgacactcctggtacttctggcctaagataccccctaagcagcaaactttgggtcctgagggagattctccttggagaaggccacatctccagggcaatttgatcttccctctgggtatgggaaacatggcccagtacagaacagagaccctgtgaaggatcattgcactgagatgactgtaattcaactcagaattctatactttctcttccccccaacacactctcctcccctccctttccctacccaccttccactcatggatgaatatttacaaatctctttgctcaaataagttctttgagaataagatcacggaggagattatctcaattacaaaagaagaaaaaaaaaaaaaaaagactatttctaagtaaacaatccaaatgtccttcaatgggtgaatgatttaaagacgtggcccacaataccatggaatactactcagcaataaaatagaatgaacataggcacaataacctggttgatttcaaaggaataatgctaatttaaaaagtcaaccacatagtcttatgtactgtatgattccacttacacaacgtacttgaaatgacaaaaaataaagatggagaaaagcctagagttttccaagagttcaggaaggatggggaagtatagtgattttggctataaaaaggtagctcaggagaagcttgtgatgtgaatattctgtatcctgacagtggtggtggttgcccaaatctacaaacgtgataaaaatttcagagaactaaatacacacacggagaaggcaatggcaccccactccagtactcttgcctggaaaatcccatggatggaggagcctggaaggctgcagtccatggggtcactgagggtcggacacaactgagtgacttcactttcacttttcactttcatgcattggagaaggaaatggcaacccactccagtgttcttgcctagagaatcccagggacgggggagcctagtgggctgccatctatggggtcgcacagagttggacacgactgaagtgacttagcagcaaatacacacataggtactcacatgagtgcatctaaaacttacgaaatctgaattcgttctgtaaattatgtcaacgtcggtttcctgactgatattatactattgttatgcaacagttatgttatgcttttggggaaaactgagtgaaagagccatggaatcactgtattttgcacaactgcatgtgaatctatagttgtctccaaaaggtttaaaaaataaaaaatgctaagagaattccctgaggctcctgtaattaaatcattctgcctttggacttaccttattaaaaaggatgtctatgaaaaatctccaaattaaaaaagtggattggtaaaaatacatcttaaagttattgaaaattctttgtaaaatataagtgtagaagtgatagacaaatagatgactttgtcaactatatttttcttttaaaaataaaggcgtaaaatcaggcattcattgacagtatttgcaatacacagactgagttttgttagctattgttgacttttctgatttccagtcaccaaatccaaaaatagcttgtcatagacttctgacatctatcatccaggtgttgtctaagatcaattctgcttgggaagttcacacatacacacaataaataaataaagtcagccagaaagtaggaggaaatgagagcaggaaacagattttgtttgtagatatctttcttgctcttcccacctgatttacttttaatgccagacatttcttctttggtcttcacttccccaaattatttaccagattctaagccagagttgtgtaagtcatcaggggagaaaatgctgactactaaagtttacctgagcagcatcaaccaggctgaagcaatgtataccctggtcctgtgaatattctagagagtctggcatttgtcttagtgctgtttgctggataacttctattcccttgctgctgcgatgttctgcattattaaacattcatccttttgtttacaagtttttcatcgcatctatgacagtggcaaaaaaatctctgtatgtccctgtctcctgcaagtccctcattcaagcagtcatagacaggctggtgccgtgaaatcctcaaagcccctgctgccaacatcacattgacaataataaaatgtttacatcactgttgaaaaagaggaggaactgtgatgttagtttcaaaaaaaagtcactgagctaattgatcaactttcaattggtaaaatttaaaatgtctactctggtaaaaacagggttttccaaacttctggagctgaagaatcaattgcaggctgatacccctttaaaattcaataaaataaatgattagaaaagcaaagagaaaaaaaaagttatagatgtaaaaatacagcctcaaaatattattactaatattttttaatgtgaaccatccttaagtctctattgaatttgttacaatattgtttctgttttatgttttggtttttagactgcaaggcatgtgggtcttacctccccaaacaggcaaccccttcattgtaactctccaacctgtaacccctacattgagaggtgaagtcttaaccacagaccgtcagtccccagttattactaaattagcatagaattactctatcaaactgccataaaaattctaaacacttaactctcaatttctgtactaatttcagtataaatatttcataagccagcattttgagtaacactgaactaaaggacattctgtcatctggtcacccttcctcacttccttaaaccttttcaatactcacatttacaccactcctctccattttctttcctctgctgctgctcttggcaaagaaagacaatcagaaaaagcccccaagtctacataatcctccacatatatgtattgtctcacttaataaaaaaaaaaaaaaaatggcaggtccagcttaatatctgacttttattctctcagtggctaaaaggaccatgcaaaggagaaattatttcagggaacccaagtaaagtcaacttgtaagttgtgggagcagacatcgaatctgtaatttttttcaaaaacctgaatgttttctgcaccatttccattttcttttataatgttctaaaaaatattattgtgtctgcataagtcaatgtgatgtgtagttatctgcatagtctagcataaagagttcagtacttttttagagttccttccattactatttaattgttcatttatgcatttctttactccctcaaagagaacatactctcttcgaaggcagagatttcacctattaacttttcatatcttccacagcatctaacacaagacataaatcaacagtctgcaaatgtaaaataaggaaacaagtattagtctcttattgttagttgaaaacttacatatgcaaattttcagagaaaactgaaatacttcaaaacaaaagcaatattttaaatatagaaataaaaataagacaacataattttaattctctttgataattaaaaaggccttccaacatcttagaaatcagcttttgttggcttggcaaagtatatgtaccagagcaattatagttatttgctttttccttaatttgggccattgtagttattttacaaagcattttggaggaccctgaagacagggctgaattgcccctggttaataaggacacttagttaataacaagaacactccagctgttagaccaacctcaagaagcaactgatgacccaagttggatcgttttccaatgtacgctcacatcttggccttgcttctaagttgacagaatctctacatctgctttaaaagctttctactttttattttaccaaagcctctttaaacattgcctatgcgtactgaggctttttcaaacaaatcagagatttttatgtttctaaagcagctatgaggactttacgttttcacaaagggaataaaagatggaggtggtaaagaatggtatatgggaggctttgtacttataactaaaatgtcttaatgaacttactgatgcatacaaaataaagggaaatggttaaaaaaaaatatttactattttgaccagtgaacttatgtcaatgaatttttctacttctttggagaagaaaattaaaaataattaacataattaaaatgataatagtcctctaaaatctcacacattataatactatgtattagtttcctaatttaggttctagacaaaattttaatggaacaggttgatatatatttaattatataattctattttttttctaatattctaggcaagcttgaaagtgacaaataatatctagaagataataaataagattgcaaaatttataatgaatctattacatcttataatagcttcttcatttatagtcctgaataatcacacagaacatacatttctaagaaaaacatgctattttactaggtatttatttgcatagtaggtatttaattactatttccaacataccaatattattatgtatcagcaataaattaccgttacattttatgttcttgatacagatgaaaaactcctcatgatatgacatgtatgttcaagaaaagtaaacatttaaattgataacaaaatataagaaattcaagaaaagtaaacatttaaattgataacaaaatataagaaattcaagaaatgtaaacatttaaactgatgcatgttcaagaaatggagaaggcaatggcaacccactccagtactcttgcctggaaaatcccatggacggaggagcctggtaggctgcagtccatggcattgctgcatcggacacgactgagagacttcactttcacttttcactttcatgcatgggggaagggaatggcaatccactccagtgttcttgcctggagaatcccagggataggagagcctggtgggctgccatctatgggatctcacagagtcagaaaagactgaagtgacttagcagcagcagcatgttcaagaaaagtaaacatttaaattgataacaaaatataagaaattcttatatttcttataacaaaatataagaaattctttaaatggcccaaactgttcaccaccgtaacatggtttgatagtcctttatagttccacatgtaccgtagctctttccagagataaatgaaacattatcctactctatttcttattatatgaaaaggtatataccctgtggctaaatgatatcaatgaactctcatgagcatttaccaaatgaataaatgagtgaatatgtgaatgaaggactgactaaacatacaaataccactatgcttaactaagactgaaaagagtgttatgttgcttttttatttcttgagatctcattctgtatccagcatgatgatattcaaatatttccagcattaataagaatttattgtttttattaagacaacatgattaatattatattatatattatatatattatattatatattatattaaagattataccatatattaattatattaatatataaaatatatatattatataagtatatttataatatataacactatacattatatattatattatacacattatattatatttttattatattatatataatataattatataatagttatattattttatttatttatatttattatatataatatataccatataatatatagtatatataaatatatataattataattatataatattatatcatattatatatattacatcttatatatcatatattatatatatttattatatataatatacaatatatgttacatatgtattatataatacttatatataatatataataaaatattatataatatatattatataaatatatacattatatatatttataattatatttatatttatatattatattataataatataatatagtattatataatataatttattatatataatatattatacattatttattatataatatatataatatattataatatatacatatatatatatataatatgcatataatataatatattgccgggagcaggagctccgcctgtggcaaaggtcatgaggacagctctgacattggcctggacttagggaaacttcataatcaaatacagaccctagaacactcttgactggattttaccatcgctggagcagctaatgacttttttcacactttctctaactttatttctggaaaaaacattctgtctaatatccttggttatgtcgctgctggtgctttaattttgcttctcataatcattcttccttgtattgtcaggattctttggcagaacattcatacgctcgcgactgagctgcatctggctgttttaagaaataaaaaaggaggagacgctggagcaggagctccgcccgtggcaaaggtcatgaggaaggaggctcggcatatgcaaaggcgggatcgagcctcaggagtccccctggaaattctctagcatctatcccccaaaaccagagtctgcctactttactgctttgtgctctcacctacacctctgactttacgggggggctgtcccccactacctctctctgaaaaaaaagagttaacttacagctccagttaataaagttcctgggtgtgatagtgtttcaacctacaaactcctttggaagtcctctagcctgcctaaataggtttttccggccacatgtgattgctcagagcctcccaactgtgagaggcatgagatgttctaaactgtctaaatacagattcctttgagcagttaaaagattgattagaaattgtattggtgaagggtttttcacttgctgggccaatgtttgctactaagtttccatatcccttacctgctgtgtccctggcagtgtattgattaatataattggtgtaagtagtagctttaatgtttgtaaccttggacccttgagttaattctttttcttgttgtagcccaccacatctttgccatataggaatggcaactttatctaatgcttttagagggtggctcctgactaatcaatcacctttagagaaaaataagttttctgaagaaagggtcttaaaatgttaacaggcctccaggccagaagatgatgcaaatcacccaaacttttgcatatggtaagtttgcaggaagaaagcctggcttactgcaagagtcaaccctttccccattatcctctatgcataacttaaggtataaaaactactttggaaaataaagtgggggccttgttcaccgaaacttggtctccccatgtcgttctttctctcaccttctggctgaattattcagcctcttttctccactaaattttctcactgagctatccatatttaacccctctttatatctttaattaacatttaaataagctgttgtttcctgatctccgatgccgtctccccttcgaattccctggatccaccggggctggaccccgacaatatgtatatagtataatacatataatgtacatatacgtaatacatacataacacatataataacataatacctataacatatatattatatattatattaatatattatgtatattaatatataatataatatatcaatatatatggtattaataatattcatatattatattaaatatgtattaaaatattaaatttaaatgaaatatatattaatatattttatatattatatactttttaatatatttatatatttatgtatatatatttatatatttaaatacatatattttatatatttgtatatttataaatgtttatatttataaatatatatatttttataaatatatatttatatatttacattatatatttatatataattatatattttatattcataatttattatatattatatatttatatgtattatatatagatattatattatatatcatatgtataatatatattatatattacatatacatattatatattatataattatatatatatgatatatattacatatatgatctatataacatacatatataatatatattatatatgtatattatatataaattatattatattataaatattaaaatatttttaatatcataatagtcttcacaactcagggatggaacctggacctcccacattgcaggcagattctctaccatctgagccaccaggaaagtcctgtatataaacgtataccgtaactttgatatttctttgagatttgcactctatttctaagttttgatttcataaatgagcagcagcaagcatttctgttaatttcatattcacctctttgttgtccctggtggctcagatggtaaaggctctccctgcaatggggagacccagcttagatctctgaatggagaagatcccctggagaagggaatggcaacccattccagtgttcttgtctggagaatcccagggacaggggagcctgagcatattctgaaatgctgttccactccagtagcttgtttaattcctttagagtttttggatggaatacacattctaagcagaattatctttcaaattacaggaattagaagttgtttaggatatttttttcatacagaaaattataatttataattctaacatcaacagcttataattcagtgtttctttgttagcttcctttgaattttttaggtcattaggtaatatttagctgagaaatatatgaattgagaagcaaaccggcaagcaataagaaaaacactagttttattgcatattttgtctgtgtcatggtatgtgattttaaacaaatctaatatatatatatatatatatatacacacacacatacatatatcaaaacatcaaatttataccttacatatatataaattctgtttgccaattataccttggtaaatctaaaagaagttaaaagcataaaacaatgtatttaaaaaagagaaatgtttactgtacaatctagataacttttgctgctggggctgctgccacgtcgcttcagtcatgtctgactctgtgcgaccctagagacggcagcttaccaggctcccctgtccctgggattctccaggcaagaacactggagtgggttgccatttccttctccaatgcatgaaagtgaaaagtgaaagtgaagtcgctcagtcatgcccgactcttagtgaccccatggactgcagcctaccaggctcctccatccatgggattttccaggcaagagtgctagagtggggtgccattgccttctccgtaacttttgctgtgatgtcattatgcaacagttttggagtctctgggaatgataatggggcttaatgagaaggtgacagttaaacttttgacttactttcatataaaatgtttctaagtctgctattgatttttcctcatgttttcaagaaatataaattgcatcagaaaacaataattagctttaattgcttgttttgagcctctgaggaggaaggaaagggattctctctagggccttgtgccacagagagtcgaggagacatatgggactcagccttctcggtaaatcaacaagtcctctggaggggggaggggggctgcctttcccacagtcccatgtagggtatctaacagataccttagcttcagttatttcttcatgagggaaatcacttgagggaattttgagtcaccgtgaacgttacatatcaggaacaagaagtgcatattttcctgaaagatatgtagaagggcctggctcagctgaactccttcatagcagtgtcctgaacaagtgtttcctgggagtgaggacagaggggccctgagactctttggtgcatgtctctgcttctgccaattcagggtaaaactgtgcaagggagaataggcaggtatttaagcaaaactgaatttaaaagaattaaaaggtcacttctggagaagtagaatcaaccaggttgctctaaataagattttcagttgagttcagttcagttcagtctctcagttgtgtccaactctttgcgaccccatgaatcgcagcatgccaggcctccctgtccatcaccaactcccggagttcactcagactcatgtccatcgagtcagtgatgccatccagccatctcatcctctgtcgtccccttctcctcctgccccaaatccctcccagaatcagagtcttttccaatgagtcaatgcttcgcatgaggtagacaaagtactggagtttcagctttagcatcattccttccaaagaaatcccagggctgatctccttcagaatggactgattggatctccttgcagtccaaagcactctcaagagtctgctccaacaccacacttcaaaagcatcaattcctcagcgctcagctttcttcatagcccaactctcacatccatacatgaccactggaaaaaccacagccttgactagatggacctttgttggcaaagtaatgtctccgcttttgaatatgctatctaggttggtcataactattcttccaaggagtaagcatcttttaatttcatggctgcagtcacaatctgcagtgattttggagcccagaaaaataaagtctgacactgtttccccatctatttgccatcaagtggtgagaccagatgccatgatcttcatttcctaaaagccaactttttcactctcctctttcaccttcatcaagaggctttttagttcctcttcactttctgccataagagtggtgtcatctgcatatctgaggttattaatatttctcccggcaatcttgattccagcttgtgcttcttccagcccagtggttctcatgatgtaatctgcatagaagttaaataagcagggtgacaatatacagccttgacgtactccttttcctatttggaaccagtctgttgttccatgtccagttctaactgttgcttcctgacctgcatacagatttctcaagaggcaggtcaggtggtctggtattcccatctctttcagaattttccacagtttattgtgatccacacagtcaaaggctttggcatagtcaataaagcagaaatacatgtttttctggaactctcttgctttttcgatgatccagcggatgttggcaatttgatctctggttcctctgccttttctaaaacctgcttgaacttcaggaagttcatggttcatgtattgctgaagcctggcttggagaattttgagcattactttactagtgtgtgagatgagtgcaattgtgcagtagtttgagcattctctggcattgcctttctttgggattggaatgaaaactgtccgtttccagtcctgtggccactgctgagttttccaaatttgctggcatattgagtgcagcactttcacagcatcatctttcaggatttgaaatagctcaactggaattccatcacctccactagttttgttcatagtgatgttttctaagacccacttgacttcacattccaggatatctggctctaggtgagtgatcacaccatcgtgattatcttggtcatgaagatcttttttgtacagttcttctgtgtattcttgccacctcttcttaatatcttctgcttctgttaggtccataccatttctgtcctttatcgagcccatctttgcatgaaatgttcccttggtatctctaattttcttgaagagatctctagtctttcccattcttttttttttttttttttttttgtctatttctttgcattgatcactgaggaaggctttcttatctcttcttgctattctttggaactcgacattcagatgcttatatctttccttttctcctttgctttttgcttctcttcttttcacggctatttgtaaggcctccccagacaactattttgctttttcacatttcttttccaaggggatggtcttgatccctgtctcctgtacaatgtcacgaacctcagtccatagttcatcaggcactctatctatcagatctagtcccttaaatctagttttcacttccactgtataatcataagggatttgatttaggtcatacctgaatggtctagtgattttccctactttcatttcaatttcagtctgaatttggaaataaggagttcatgatctgagccacagtcagctcccggtcttgtttttgttaactgtatagagcttctccatctttggctgcaaagaatatcatcagtctgattttggtgttgaccgtttggtgatatccatgtgtagtcttctcttgtgttgttggaagagggtgtttgctatgaccagtgcattctcttggcaaaactctattagtctttgccctgcttcattccgtattccaaggccaaatttgcctgttattctgggtgtttcttgacttcctacttttacattcaagtcccctataatgaaaaggacatcttttttgggtgttagttctaaaaggtcttgtaggtcttcctagaaccattcaacttcagcttcttcagcattgctggttggggcatagacttggattactgtgatattgaatgatttgccttggaaacgaacagagatcattgtgtcatttttgagattgcatccaatactgcattttgaactcttctgttgacaatgatggctactccatttcttctgagggattcctgcccgcagtagtagatataatggtcatttgaattaaattcacccattcccatccattttagttcgctgattcctagaatatcgacattcactcttgccatctcctgtttgaccacttctaatttgccttgatccatggacctgacattccaagttcctatgcataattgctctttacagcatcggaccttgcttctatcaccagtcacattcacaactgggtattgtttttgctttggctccatcccttcattctttctggagttatttctcaattgatctccagtagcatattgggcacctactgacctggggagttcctctttcagtatcccatcattttgccttttcatactgttcatggggttctcaaggcaagaatactgaagtggtttgccattcccttctccagtggaccaccttctgtcagacctctccaccatgacccgtccatcttgggtggccccaagggcatggcttagtttcattgagttagacaaagctgtggtgttagtgtgattagattgattagttttctttgagtatggtttcagtgtgtctgccctcttatgccctcttgcaacacctactgtcttacttgggtttctcttaccttggacgtgggatatctcttcacggctcctccagcaaagcgcagccactgctccttaccttggacgaggggtatctcctcaccaccgccccttctgaccttgaacgtggaatagctcctctaggctctcctgcacccgcgcagccaccgttccttggaggtggggttgctcctcccggccgcagcccctggcctcgggcgtggggtagctcctctcggctcctgcccctgacctcggatgtggggtagctcctctcagctgccgtccctaacctcggacgtggggtagctcctcttcaccattcctacatcgttgtttacaccaattggcctggcagggaaaaacaagtgctgactcacaagaccacaaacaaaaacaatgggaagaaattgtaaggataaacattttagataccatgcttcccaggattgatgataatacaggtggcttatataatagtatttgggaggtaaggaaatagatatttaattgcatataagttaactagaaggacatgaaaatctaccagaatcaagaaaaagatgatcagtggattattcactccccctcacctcccaaggggacaatagacaatatctggaggcatttttggtgtcacaatgcagggacaggggtgaatgtactatcatctagtggacagaggccagagaagctgcacaggatagctcccataaaaagaataatccagtccaaaatatcaatggtgtcagaattgaaaatctctgaaaaaaaatcactgataaagaattatgatagtgagaactggcgtggaaaaattgccttctgattgttacttaaatacacttgtgaaaatactatggtggcttttcatagtataaaaattaaatatatgctctgataatccagtaactctgcttctgaatatttatttatttaattcaaatattgatttaattcaaaagaactaaaatgatttaaaagagatattagcattcccttgttcattgcagagctattcacaataacaaagattagaaataacctaaatgtctatggaccaaaaagtggatcaagaaaatgtggcatgtacataaaaatggcataaaaaaaagaaagaaattatgcagtaaattaccacatggatgacagtatgcttagtgaaatatgtcagtcacagaaagacaaatactgtataactccacgtataagttcatggagtcaaaaagtggagtgatagatgtcataggcaagaggagggggaaacaggaagttacaaatcaatggacataaaatatcaattaagcaggttaaatgggttctagagatatactgtacaaaaatcatattggtagtcaacaatactgtattgtacatttaaaatatcttaatttggtaggtcctatgtgaaatgttcttaccacaataaactaaaaataaatattagtacaatatgatcactaaaatctaaattttacttggattccatcagctttttccctttaattccctctttattttcttggacccaatccagataccacattgtactgtcatcatgtctcgctaatgtctcatctgttacaaattttgactctttcctttttttttttttctcctttggcttcaataattttaaggagtatggatgaggtatcctgtagaatgcttgcagatatgggtttgcttaataaatttcttatagtaagatgagataatagattctgtggaaagaatgtcacagaggtgaagtttctcatcacatcatttcaagggataaatgatgcccacactgcaccactggagatgctcacctttatcttgtacttcaggtaatgttggtcatatttactaaacttgactgtgagatttgaaatggagttgagttaataaaaattatttctactgtgttaattttccttatttaaattctatagtccttggtttctacaatgaatatgtgttatttcaataattcaataaacagaagtaattaatggaatggatgtggtggtgcaatcaaacagaacagctattttaaagggatcagttcattgtccaaactaaatatttaacttagtaaatatctctgctttaactctcaatgaatcatgatgatctaaatgctggaccttcatacttcttccatatgttagagtaaaagtatgaaggaacaaggttatgcctggcatgttatagtccttaaattaatatttaataatgatttcatctataattacataatttttataattgtaaaaaagtatgagtgtgaggaagggtctgagagaagtgattttaacctacaaatgttcatgtgaaatgcccctaacgctgctccaggttttatagaacacaagaaagaattacatcagagaattgtgattaattttaatcatttcaaggctttaagagaatgaggcaacagacagtctctagggtttatgccccataggttgtgactttagatataagactatatccatcactcccaaccaggagagattctactttcacccatcagcaggtatcatgggaagctgctgtgaaacacaggagctcagcctggcactctgtgatgacctaggagaaggcatgggactgagagggggaggctcagaagggagcaggtatatctgtatataccccttccaaccaaaattattttttttaattttattttatttttaaactttacataattgtattagttttgccaaatatcaaaatgaatccgccacaggtacacaaccaaaattaaattcaaaaataagattctaaacaaaaattaatattattttctaagtagggtattagaaaaaaagtgtgagggaaaatttaccatttagacatagagagtccttgagtaatactgagtcattgtgaaagttaccaatctgaactgtaaaggaagaggaagtggactcagcctacagagctttgtgtgagaactggctcagctgagcccttaaaacagcagggctgccccggtggaacagtggtaaagaatctgctgctagtgcaagagatgcaagagacttgggtttgatccctggtttaggaacatcccctgaagtaggaaatggtaacccacttcagtattcttgcctggaaaaaagtccatgggcaaaggagtctggcgagctacatgcagtccatggattcacaagagtctgaagcaatggagtgactgaacacaagtgcctggaatggagggttagaagagctctgagaatctgtgggaggtgcattatctggtgtctacaaacttttgaaggagtagtcaaattgaaataaagacaaatatttaataaaaaataaccagagattaaacaaatgctagtgaaagaaacgtaaaaggcactatttttaattaggtatgtaaaccagccttgagagcaaaaattaaacaaaatagagaaaaaagatataggaaagatattaactgtcatatttcctaaatccaaagaaactcaccagcaatttaaaaataacatttgagtcacaaaatccattggatgaaataaagcattagtttaatattaattttcacgtggcttagacaaatcagctatatttagaatgtctagctttgtgatagattgttttttttaaatttatactcaaatttatgagtataggaagatatagggatcttgagtgtctcagttttgcctatggtctgacatcactgttgagccatataaaatatatttcttgagttatgggactagagacaaccttatcggaaatgatagagaaaagtcctggtatggtagggtctaagaggtgtaggtcaccaattgtgcatgcatgtgtgctgagtcactcagttgtgtcctattctttgtgacttcattgactacatagccaacccgactctgtccacataatattccactcaaggatactggagtgggttgccatttcctccaccagaggatcttcccaacccagggattgagcccacatctcttgcatctcctacattggcaggtggattctttaccactatccctttagaagtcattggtcaccaattagagaaatacaattcttttctattagcattttctcatgaaatatcatcacactgaagtactaccttaaatgtttgatctttctcttttacaggtaatgtagggacagaataaatgtctttatttatggacatttctatgttagaatctttagtagagttagttacatttttctcaacttcctttctcatctcacctgctgctgccttctagtatagctctctgatatgtacattttcattggacaatttcccataggtttaagatcactagtttgtcacaaattggaacatgattatgagtaaatggaatatcttagtactaagacattgaacatagattctcttttagacaaatggaaaattccaggagtctggatcaagattccagtcacagacgtgtagattgatccttatttgcatgttacagggaaagtcaaggatctctgtcttctgctttgtcatgtctttgataaagacatagactgtactatccttattatttgttcagtgttattattccacaagcaatgaggtggggtaattagggctccctggggtgagaagaacactatctgaaaaaaattaactaaggtttattttgacaatagatttactgagtcagaaacaaaagtaaatgttaaagtatcatgtggaattaataataaaggcacagatgtgaactattagaggggtcattcttagggtcacattgtgaacatgtgatgcaaagtgtaatttaaaattttcccacttctgctgctagttttaggactgaaataatcagttatggtactaggctaggttaatcttttatgaatttataatgttcaagaggacctaaaagtgttatagaagggtttcacttaaaataacttccaaatcttttgatttcatatcatctctaaatgttgaaattataattcaaactaaaaatttcaataagggtactgtgctacttaaagaaaagtttaaatggttatcttttttaaattttagacatttagcaatcgtgagtaagaaacacagagagaggttctaaaagagacactttgcttcctcttccagctttggaaaggaatagttaaccaagtgtcttacatccttatttcccttaatatttttctttctaggactgattcagattctgacaaacagaagccatgtttctatcagagagaaataaaagtggggccgtgttcactctcctgggcttctccgattacccagagttgcaagtccccctcttcctgacattcttcaccatctacagtgtcactgtggcggggaatcttgggatgattccaaccatcaaaattaaccccaaactgcacacccccatgtactttttcctcagccacctcccctttgtggacttttcttattcctccatcgttgctcccaagaccatggtgaacctcacggtagaagacagaaccatttcagttgtaggttgtgtaatacaattctttttcttttgtaccattgtggtgactgagtcctttttattagctgtgatggcctaagactgctttgtggccatctgcaaccctctgctctacgtggtggccatgtccctgagactctgtgccatgttagtggttggatcttatgcttggggagtagcttgctccttgatactcacctgtgctgttatcaaattatcattttgaggtttcaacacaatcaatcacttcttctgtgagttctcttacctgctttccctctcttgctctgatacttatctcaaccagttgctgctttttattttctccacctttaatgaggtcagcacactcttcatcattctcctgtcttatgtgtttcttgtcaccatcctcaagatgccttcagcctgtggtcgccacaaagccttctccacctgcgcctcccacctgaccaccatcagcatcttcccgggcaccattctcttcctctactctgtgcccagctccacactctccaggcacacaatcaaagtggcgtctgtgtttacacggtggtcatccccatgttgaatcccctgatctactgtctgagaaataaggatgtcaaggacacagtctccaacatcatggactctaaaatattttcataataaacattattctggaagattttgcccttgatatgtaaataaactgtgtctgcaaaggttggttgataaaaagagatttattattaatgaactgttaatacgtaaaatagaaagtacatgtgttttgcttaaccatactaaacttgactttctctcttacttactgggaaaaaagttagcaatctttcaagtctttttcatttaaaattttagacaaaataatctgattacaaaggttaaaggacataaatatcatgtggcatacttgtgtaatcttaataattgttaatttcattctccttttttaatacctatggtagactaggctctcaataataacatgccttcctcttacaaaaagtacaaatagcagttaagacatagtgttcatccttcaagggatgaaaattcagtgatgatagtagggcactttacaaagtagaaattgtataagatataaaacaataagtataatagaaggtttcagaggaaaaatttcaagtccttaagagagatacttttataaaataggtattatgtaccctgatttggaaaacagaagagacagagttttaggagacatattccaacattggagttttatccaggagactaaagcctgagaaacaaggaggtcagagcgcaatactgagtcaatgatacaacaataattttttttaatagaataaatactgtgtttgcatatttggatatttttggatattgtatatgcagttcactgcagatggtgactgcagccatgaaattaaaagacgcttactccttggaaggaaagttatgaccaacctagatagcgtgttcaaaagcagagacattacattgccaacaaaggttcgtctagtcaaggctatggtttttcctgtggtcatgtatggatatgagagttggaccgtgaagaaggctgagcgccgaagaattgatgcttttgaactgtggtgttggagaagactcttgagagtcccttggactgcaaggagatccaatcagtccattctgaagaagatcagccctgggatttctttggaaggaatgatgctaaagctgaaactccagtactttggccacctcatgcgaagagttgactcattggaaaagactcatgctgggagggactgggggcaggaggagaaggggacgacagaggatgagatggctggatggcatcactgacttgatggacatgagtctgagtgaactccaggagttggtgatggacagggaggcctggtgtgctgtgattcatggggttgcaaagagtcggacatgactgagcgactgatctgatctgatctgatctggcatgaatgaaagttgataagacatggtctatattcccaatgtgttttcaaaagagctccagtgtggcaacataaccagctatgattgttgttgagtcactcagttgtgtccaattgttttgcaaccccatggactctagtctaccaggatcctttatccatgggatttgccagacaagaagactggagtgggttgccatttccttctccagtgatagagtccaccagagacttaaaaatggtagactagatctcagaaaattttacatacaaaaaggaagcatggtgagtacctgcctaacatgcatttcaagctattattctgcctatgaagacgtcaaaaacattatcaggttttttttttctttcctgaataaaatgtctgtatccttctcaactaaagaaagtgaaagtgaaagttgctcagtcgtgtccaattccttgtgaccccatggactagtccatagaattctccaggccagaatactggagtgggtagcctttcctgtctccagggaatcttcccaacccagggatcgaacccaggtatcccacattgcatgcaaattttttaccagttgagccacaagggaaaccctctcaactaaactcctagctttaaaaaaacagtacttggagtggccctaagagttgaaaaccagtagcctgtttgaccacattcaacatacgagaagaaggtagttactagcatccagacctattcaatctggcaaattagaaataccagatcttgggacttttctggtggtccaggggctaaaagtctacactcccaattcagggatcctggctttgatctctggtcagggaactagattccttgtgctgcaactgaaagactctatgtgctgcaactaaggtctggtgtagtcaaatgaataaatattgaaaaacagaaataccaagtcttccaatgttctggtctggagaattccacggggtcgcaaagagttggacatgactgagcaacttttacttcacctaacattaatagctcacttttgcttgaataaattgtacactattctctctattcaatatatctagataaattctgcaatgtctacctgtcaaaagatctaaacactcataatatttgagagcattgaatgtaaatgggaatagaatctgtcagaatttgtgctggaataggaatgacacaaatatttcagccaatttctcacaatgatctttcctcaaatttttgaaagtaatacattaaagttagattgccttctaattttgctgaagactaaaattttggaagttatatcttttaaggtgatttgctatccaatatggtagttttcaacatgatcccagttcttcagttatccaggtatccatgccgctttctactcttctgattaacggtggaatcaatctctccacattctgaatgtagactactttgggactagctttgactgatataaaaggtagctgaagagatattgtgccatcttcaagcatctgatggccctgtgtctttctcaaaatctcttggaatttgcataatctcttagaaaaactgccatgtgaataagcacaggccagcctattggataatgagcaatatgccttacacccctattccatgaaatagcatttagcaacctcccaactggagtatgaggccttcttagatcaccgagactgcaaagctggtaatatacacgtaagtacaccagccaagatcacatgagggtactgaccttactgactcatgtaatagtgatccatgcaataagcagcagttttttgttttttgtttttgtttttaaactagtgttttggagcagcttgttatgctgtctttaaaaccactgacattcttaatttctgatgttaccacaaagacattttcaagtcttatcatatagcaactaagcatatcagcttttcttaaatgcaacttgattaaaatgtgtaattaaaaagtttaggcaatttaacttgttgatgtccttgaatcttttgatacaatactttaataaaattatagtatcttatttgtataaatatagttcatcaaaaacttacaacttcataattttattatgtattttattaaaataatcattaaatagaattcaattataagtttatatttaaattacttttaaaaaaatacctgccttgcctttaagacttagataaatagataagcagagagttcattttgcccagatgatataaaacatcactgcccatgttgttctttatagatgtctttttattcttcctgtaatggaactctctccctcagggagatgaattttaaaactggcaatactttcagggtatacaaagaacaacaacaacaaaaatagatactaaatagatatattatgatcatcaatccactaatatctaatttcaaaacatcactgtatagtctaaaatgcctgtgtaaagtccttattttttgagggaaaaaaaaagatatataaaccagagagaaacaagaagtcatgtcaagggctggaaaaatcttgattaaagcttatgtcagaagctttctctatctcctttatactttaataaaacttcattacacacacacacacacaaagagataatgtcaggctttctggaaagcagtacttcacagcactcatgttttaagttttgggagtttgtttttgcttttctaattgggataattcgccaggtaatacatgaatgaataagaggaatccttgtttctgaaaaatgaaattgcatggaattcttgaattcttggtatattccagggcacacacaacagactctcctttaagcactgttggatgaaggagaggttatgcagtcagataagaagtgacttgggagagatccttcaggcagacccattaaacggtctctgcattgagccgggagcacggtttccagcaccgtcattggctctgctcttcctaacacagggccagatggcaaaaaccaaagagcagcatataagctcattctatcaatgatttcacttatgactttgtgcaagttacagctgccagtgtctaagtcatcttagatgctgcatagcagtaatcatctcacttattttcatagctataatcatctcacttatttttataaagatgaaaggtgtgggtggttgcattcagaagagtacacagcacatacaaagtgatcagcaaatgtgagcaattgctattattctcagcaaaggtggatcattatttccacccctttctggtatttggcagaatgctattgtgacttcaaaccctatgtcctccagtaaggagctctaagtgtaagactggcacagattagaagacttatccacatatttcataatggcaacataatccctggttcagagggcaatatttgaatgcagcaaaaaatgctctgcagttcatcatgacatctgaaaggaattgtgttgaactgtgtaccaacttggggctttccaggtggctcagtgggtaaagaatccacctgcaattcaggtgacgcaggttcaatccctgggtcaggaagatcccctggagggagagcatggcaacccactcctgtattattgcctggagaatcccatggacataggagcctggtgggctatggtccatagagtcacaaagagtcaaacatgactgaagagacttggtacatgaaccagctttaaatagcttttcccatctgacgacatctcatacaactccttaattatttgagtcccaagatgacgttgcttgctctcaagatgaagttgtttgcttgatgtcttgttggtgtcccacagagatcaatgattggtttggaagcttaagaaatatgagctccagggatacacacacataaaaatgtagagcatgtaacattttccctcatagcatcttcacaaacaggaagcaaggcctatctcacgggttggttggactacactctgttttggggggaatggactgaactgtatttcctgaggtgtggaagcttgtttatttgtttgtcttctcataagggtagtattgttagccatgtatgagaggtggaacaattgtaaaagagggtagtgacattagacatttttaaaagtctgtagttagcctgtatttatagagtattttaagaaatgtccaaattttgagcactccattttgaaagtattttcactttttgttctgagaaacaatcttgacaggacatggaaacaactcgatctgcagagccgaatttgaaacagctgtcagtttaagagggaaagagtatgagccaacagggaggaatgctcgattcctctcccctttcctcctcctcccccctcactttaactccatccatggaacctgggaaagacagcagggagagtctcctgaagtcactctgaggctgggagtaggtgctgagggctcctcgaaactgttccaggaggaacacagacatgtgaaccacctctgaatcagacaggagggggattactttgtccttgtgccaaagggatttatagatgtctctctatagcaattttctcacatttgatacctttgacattttggcccaaattatattttggtcttttcatgtgttgtgggtgtgtgtggaggatggggtggggagggagatgctgttctgtaccttctcaactattaagcagcatcttgtctgcccagggggcttccctggtggctcagagggtaaagaatctgcctgcaatgcaggagacccgggttcaatctctgggtcaggaaactcccctggagacaggaatggctacccactccagtattcttgtctggagaattccatggacagaggagcctgtcaggcttacagtccctgggggtctcagtcagaaacagctgagtgactaaccctttcactttcactggtcggtccactagatgtcagtagcaaccctcccgattgtgacaatcagcagtatcttcagatattgctaaatgtcctgtggggttataatcgctcctggttaagaaccgcttctctctataagtaatcagtagcctgatttttctttaaaaactggaaaaggttttacacaattatgtactactttgaaatcagaaaaagacgaagtcacttgtactggccattgaggaaagaaaaccatatcctcagaataattatgttttcaaaccacaatattttaattcgcatgtcctttacctcttcaagggcttcccttgtggctcagctggtaaagaatcagcctgaaatgtgggaggcctggcttcaatccctgggttgggaagatcccctggagaagggaaaggctacccactccagtgttctggcctggagaattccatggactctatagtccatggggtcgcaaagagtcggatgcgactgagttactttcacttcattcacttacctctttgagtggctcgagggtaaagaatctgcctggaggatacacctgagacgttctgtacctgggttggggagataccctgaaggaggaaatggcaacccactcggtattcttgtctgagaaatctcatggatgtagtggcttagcaggctacagtccctagagttgtaaatagctggacacaactgaacacacacgcacacattaacctttctgaagttatttgaagaatgtggaaaataccagatgtgttgggatttagtccagattttttaccccctgaaaataaccaactggtgcctccaaatcattttattgttactaagggtgagtagagaaaatacccttcattggcattttcaatatgtcaaaagctttgaatatatatctcctttattaaaaaaaaaaaaaaacataacccttaaaacttttatgttttgtgagaattcaagcaagattcttttctaaagtttctttttaaagttatcagaataaaatacttatatttaatggatgttgtgaagatcagatatacaatgcagcttatgtatgcatgtataatattctgtgtgtgcaacctgatttactacgtttttacttgccatcttatcataatcatttttagatcattaaaacttcatttatggcaaagccactacaatattgtaaagtaattaacgtccaattaaataaatttagattttaaaaaaagcaaacttcttcaaagagctgtgattttctatatgtatgcagtgtatctttgaacttttttcctgttgctcgacactttatttctaaattttgctttcataaataatggtgcaatgcagcagcaagcatttctgttaattacatgttcacatcattgtttagctcttcaaatagagctaaaacagaggatatatttgtcaaataggtgttcataaggcttgagagtcacagttacagaatgtcagattttgaatatcagttccctgaagaatgacagacagtgtgtgccataattaacaaaatcgctatgcaaattttataggaaaatatactaatatagattataaaatctgctttcccagctaaaccatatttaaataaatgaacacttgtgaattagcaatcttaaataagcatacttcatatatttcattataaaagattttctaaaaaattatccactgaatcctaatactttgagaaatgattaaatagtaagtcagtaaaaaggtattggaatatttttaataaccattttattgacctatagttaattttcaatgctgtgttcctttcaggtctacagtaaatgattcagatatatctatatctatgtaactgtatctattctgtataaatatagatatatcatattctttttcagagtcttctccattataaattattataagatatggaatattgtcccctttgcagtataataggtcattgttatttattttatatatagtgactgaaatttgctcagtagtgtccgactctttgctaccccttggactatacagtccatggaattctccaggccagaacactggagtgggtagccattcccttctccagaggatcttcgcaacctagggatcaaacccaggtctcccgcattgcaggcgggttctttgccaaataagccaacagggaaacccttatatgtagtgctgtgtatatattaatttaatttaaaaaaatggataattaaataatatttgatatctttctgatgattcagttctaagctctgaattatatataactagtttaaggaatcatacaggctcatatggatgcaagtctttcctgtgatctgtgaagtaaactatggactcgatgtatttgagtgatgcaatttctgagcttttcctaaacttccccaaagcaatgccttatttatttgttataaaatgtaccctatatatcatcatgtctcttttaggagaatgcttctgctgctgctaagtcacttcagtcatgtccgactcagtgccaccccatagacggcagcccaccaggctccccggtccctgggattctccagcaagaacactggagtgggttgccatttccttctccaatgcatgaaagtgaaaagtgaaagtgaagctgctcagtcatgtccaactcttagagactccatggactgcagcttaccaggctcctccatccatgggattttccaagcaaaaatactggagtgggttgccatttccttctccccttttaggagacagtcaactaaattggggatgatctcatggagaataactattaatatttttctgcaaccatggtaaagggaggacatggacaaggaaaactgcactgctgtgacagacttcctccttggattctcagatgcccttgagctcagagtcttcctcttcctgcggtttctttccatctatagagtcgcagtttggggaaacctgggcatgattgctctcattcaggtcagctttggactccacacccccatgtactttttcctcagccacttgtcctttgtggatttctcttactccactaccgtcatgccgaagatgctagctaacatcttaaatgaagacagccatttccttcctggaatgcactgtgcaattctacctgttttgcacatttgggataactgaggtcattctgccggcagtgatggcctatgactgctttgtggccatctgtgacccactgctctacatggtcaccatgtcccgaaatctctgcatggagttggtgtcttgttgctatctcaatactactgtatgttctgttactcacttgtgtttagctcttcagatcccatcctacagatcaaatgtgatcaaccacttcttttgtgatcttcccgctgtcttgtgtcttgctttctctgatgtcaccgggaatcgattggtgctatacattgtggccactttcaatgaggttatcaccactgtggtcatcctcacgtcctacttgtttattctcatcatcatcctgaggatgcgctctgcagacaaaagatgcaaagcttttccacgtgtgcttcccacctcactgccatcatcgtctttcacagaacagtccttttcatttattgccagccccactctggcaacagcatgggcactgacaaagtggccacagtgttctgcactgtagtgatccccatgctgaaccccctggtctatagtctgaggaacaaggatgtgaaagaagtgcgcagaaaagtggtaagctccaaaatattatcctagagaatattttcctagcaggactcagggttagaaattggaggctgatgaaagggtaatgatgcgtttcagtgttggagtgaaaagagcagtcaagatgtgaatagctatgagtgagtctttttaattctctttgtgccttttcaatttacaagtttaggattgattgagaatatttcaaaatgtgcagcctacttctttgctttgatgctatataaaatgttttaaattggacagtatactggactgttaaagcacacaaatttaattttctcttagactttcatgagtttaatggactaagtatcacattgtattttaacatccattatggggactacgattcatttcataattgaacacctattattttacaataaggaacacacctttgtcagtttttacagagaataagattccatatgtgtatataaatataaatatatatattctctttattgttttgttcttacttcctttattattttttgtttttgtcattgcagtgtccagtggtttaggggtttcatatattatcacatatgaataatagaaatattgataataattacattacagaaattttagggaaattaaattacatgtccagtgaaaatagcctaggaatatacctaacacataattggtcatctctttatgtatgtgtatatgtgtgtctctttcatgcattggagaaggaaatggcaacccactccagtattcttgcctggataatcctagggacagaggagcctagtgggttgccgtctatggggtcacagagtcggacacgactgaagcgacttagcagcagcatatgtgtgtgtgtgtgtgtgtgtgtgcgcatagatgtatattgtctattgcacttgacagtattgtgctttgcagatactgcatttttacagattgaagatttgtggcaaccctgcatcaagcaagtctattagcactgtttttccagcaacatttgctcactcctatctctgtcacatgtcatattttggtaattctggcaatattttaaactttttcattactgtgtaagttatggtgatctgccatctctgatgttactattgaaaaagattataacccactgaaggtttagatggtgttagcatttgaaagtatttttcaactagaatatgtatattttttagtttttattgatttgcaaaaagtttttaaattattttattttatttggctgtgctgggtcttctctgtggcatgtggacttctctagttgcagtgtttgggtttagttccctgtggcatgtggtatcttagttgcccccaagggatcaagcacaggtcccctgaaaaggacagtggattcttaaccactggaccactagggaagtcccaatatatgtacatttcctagacataatatttcagtgtacatacttagacatatgcacactgaaaatgtgtttgacctgctttattaatgatatttgccttgttggaaagagaaagtgaaatcgctcagtcgtgtccaactctttgtggccccatggactgtagcctgccaggctcctccgtctatggggttttccaggcaagaatactggagtgggtagctgtttccttctgcagggcatcttcctgacccagggatcgaaccagggtcttctgcactgcaggcaggctccttactgtctgagccgtcagggaagcctaatttgccttatcacaataaagtgaatataccaaacctataatatctcccagctatgtctgtatgcttataaatgtatatgcctacatattatgtagatatattaatatattatatatgtgtatgtattggttggttgttgtttagtcactaagttaggttcggatctttggggaccccatgggctatagaccatcaggtacctctatgtatgcaattatttaataaccattgttatgaagagcagcattgctgacttttgcctcttttctcactttcaattactttcttctggcttactttaaaaatatgcattaaatgcttactgtgactcataggtggacttctaacctctgtgtacatttcttttctgtgtcttgatgaaatgacctttgttcatccttcctttatgtgtttaaacttcatttcttccttcaaccttggctcatatgtgtcactgatactttatttgtgcttccattatgatttatgtaaatttctacattaaattcacttgctcaatgaagcatctctctgtgtgtctatactaacgttagaaagcactacactggagtttatgaaaaccgggataggcaatttgactcttattttttaatttgacaagtaacacaaacttctcaatttctcagtttcctcaagtttgaacaatggttattactgttaacctctcaacattataccgagattacattttgacaacatgtaggtactcactggcactaggaagatcctttatgtgtgtttcagtgaaatctttggggcctggaactatttattcttttctctctcactatcatgtattatatttatttttttattagatagatgaataaaaactggtatataaactgtatgtatattgagcttttggggggtgttagttctaaaaggtcttgtaggtcttcacagaaccattcaacttcagcttcttcagcattactggttggggcatagacttggattactgtgatattgaatggtttgccttggaaatgaacagagatcattctgtcgtttttgagattgcatccaagtactgtattgtcaccctgcttatttaacttatatgcagagtacatcatgagaaacgctgggctgggagaagcacaagctggaatcaagattgctggaagaaatatcaataacctcagatatgctgatgatactacccttatggcagaaagtgaagaggaactaaaaagcctcttgatgaaagtgaaagtgtaaagtgaaacagttggcttaaagctcaacattcagaaagtgaagatcatggcatctggccccatcacttcatggcaaatagatgtgtcagtcactctcctaatatattatttccaagacagatgttcagatctttccatcaggaagaatgtctctgaccaagagaaatataaccgttggggccacattcgccctcttgggttctcagactacccagaactgcaagcccccctcttcctggtatttctggccatctacaacttcagcatagcagggaaccttgggatgatggtcatcatcaaagttaaccccaaactgcacacccccatgtacttttttctcagccacctctcacttgtggatttctgctattcttccatcattgctcccaagacgctggtgaacctacttgcagaagacagagcatttcattttggggatgtatggtgcagttctttctcgtttgcacctttgtggtgactgaattaattctgtttgctgtgatggcctatgacggcttcgtggctatttgcaaccctctgctctacacagtcgtcatgtcgcagagactctgtgccatgttagtggtcacgtcatatgcatggggagtagcttgctccttgactctcatgtgttctgctgtcgaattatcttttcacggtttcaacacaatcaatcacttctgtgggctttcttccttgatttccctctcttattctgattcttatctcagccagctgctgcttttcactgttgccacctttaatgaggtgatcacattgctcgtcattctcacgtcttgcgtgttcattgttgtcaccaccttgaagacgcaattaactgatggtcggccttctccacccgcgcctcccgcctgaccgccatcagcatcttccccggcaccatcctcttcctctactctgtgcccagctccacactctccaggcacacagtcaaagtggcgtctgtgttttacacggtggtcatccccatgctgaattccctgatctacagtctgagaaataaggatgtcaaggacacagtcagcaaactaatgaaaacaaaattgttttcacattgaaggcatgtaactgctaaatatttactttggttattaaagaacacttttctgattttgaatggattatgtcaaaaatttacttaacaaataactttagatttgaaaaacaaaaacaacaatggaaaaaatatgaattttagatcaggagactatacctggttctgactaagtcagagaagatggattgacctgactcagtcattatctacaaaaccagtttaatattattttgttcataaagtggtatatagaacaaaagaatatagataatatatcaaacatattgtacatgtgctgtaaactctagttctgttattccttttttcctgatgactaatgagtagtcttaaataaatgaccaattttatactttaaatttagtgaatagatgacagggaaagatatagttttactttcaggaacctcccaagccagtggtgttagttaatatcataatacagttggtgggaagagactgtacaaaatcatttatggctatcatgcctcttttacttggccttgaaggatagacagatttttaaagagaaataaaagagaatgacataagttttacttgaaagtgagagttggactgtgaagaaagctgaacgccaaagaattgatgcttttgaactgtggtgttggagaagactcttgagagtcccttggactgcaaggagttccaaccagtccattctaaaggagatcagtcctgggtgttcattggagggactgatgctgaagctgaaactccaatacttaggccacttcatgtgaagagttgacttattggaaaagaccctgatgctgggaaggactaggggcaggaggagaaggggacgacagaggatgagatagctggatggctacaccaactcgatggacatgagtttgagtaaactccaggagttggtgatggacagggaggcctggcgtgctgcgtttcatggggtcgctaatgacttcagaaacaactgagcgactgaaatgaactgaactgaaagaacataatggtcaagagtcaatgattcaaacatattttaagctattattgtatgtcatatgcctacaaggtatcttgccaggtgcttgaagaaatgaaattttgcatacattgtagctacaattctaacttattttggaagaaagtttcagtatagagaatgaaagaatttacaagaggcttaagaaaactagcttgcttcttgaaatactgagaacaaaaacgtagatactttacacatattgtatgttttgtgttgcctatcacttaccaatcattatatatatattattacttcacatggcagtttgatcaagcctgtatcttagttctccttaacaggactctctagaaagtctccataaaacaattgagtagatttgctgtaaaaattgggagctaatagctttcctgggacttgaacattgctttaaaatagctctaatttttaagtataatctaaactttgaaataatctaatctatatggttgtgtatatcagggaggattacattttcctctaagcaatgtgatatttaggggcttccctgatagctcagttggtaaagaatccacctgcaaagcaggaaacccaggttcgattccaggagtcgggaagatccactggagaagggaaaggctactcactccagtattctggcctggagaattccatgaactgtggtccatgggtccaaagagttggacatgactgagcaactttcactttcaccctcataggcacatatatctaatttgaaattagcaatcatatttatattttctttcatctgttgcctcatcagttttgctagaattacttatgcatctgttttctgttctataatctttgtgtctgaatgaaattccaaatcttttgagaaaaatattaagagaaataattctattttcatgaggatgaagtaaaaatttgaaaacagttcaatggggtaatttcaaatccttatatgatgtcaaacttacaaggatgaattatgtaaatcacttttttctggttaacattttgatatgtagtgataaccaacattattttatatattcataaataaaatatattcttctacaaatcattgcttacttgatatttacattaactagaatatcagtggaaagtagcagaaatgttatattaaccttgactcaaatcagtaataaataatccattttcagagcataaattttcatgtttcttctctatcttgacaaaggatgactaatttttttgattaattcagagacaaaattcctttattcttattctgaaaaaatggaaatacatattacttaagtcctctgatcgtgatttaaaaattagtgtgtggcataatcaagagaattatttaatatggcaacactacaggcattgatgctcttcaataaatactgatgtaaaattccatactcttctattatttacctttagatttcaattcatttttggtaactcctatagctgctgtagagtataatttacattgatgttactcattttttaaactcatgtgcctctaaaatgagtgacttaaactgcttctaaagaaatctcagttatgataatgtattgagttaaatatacaatggcagaaagcatctcatgcatgaatatattgatataaaacaaagtagaaagtagactttagaacaagaaatatcactaagaataaagagggcataaaatgatgaagctatgggtttatcatggattagcttcttcttcagagaaggcaatggcaccccactccagtactcttgcctggaaaatcccatggatggaggagcctggtaggctccagtccgtggggtcgctaagagccgggcacgactgagcgactttactttcacttttcactttcatggattggagaaggaaatggcaacccactccagtgttcttgcctggagaatccgagggacaggggagcctagtgggctgccctctatggggtcgcacagagttggacacgactgaggtgatttagcagtagcagtagcagcttcttctttttagtctaaaacttaaggaaagaaattttccaagttggtttttctgttttaactctgaagtaggcaaatcactcaatttttgttgctactgttgctacaatttgttttgttttgctttgatttgttgtttgaaagtgatatgttttcaatttaaagaattggagaattttcaatgttaaggaaattagttcaaggtatggagaatatgcacttcccaggtggcactagtggtaaagaacccacctgccagtgcaagagaagtaaaagacttgggttcaatcgcagggtctggaagatcccctggaggacggcatggcaaccctctccaggattcttgcctggagaatcccatggacagaggagccttacgggccacagtccatggggtctcaaagagtcggacatgactgagtgacttggcatgcatgcatggataatataccaggtatactggatagcaagatttccagtacttgactcagtctcattactgtatatatgaaagcatgtataattctcctgctgctaggaaggaaggcagagaataaaattgctcaattttcatttgttttttccctcaggacaatgtcagaatggtagatcctactcacatagaaactgccctgtagtacatgagagaccttggggaagtctttacttgcctttcttaatatggataaaggagttatctttttagggttgaggcaaatgagagtgataacatatgatatctctgtgcattcatacctctatatatacatcttcacttacatctgcatatatacactacatgtgcaatttgatatctttatttttttaattaagcatattttaaaaaatgcaaaaccataattttaaataacataattttctacccaagatatgataccccatagttttttttaaaaagttctatttttttactgttaacttaccctattctaaacaatgttacattgtagctttggcaatagtattttctcaattttatcaaaatgtaattaaattatttcttttaataactaacaaataataagtccacctgcaatgtgggagacctgagtttgatccctgggttgggaaaatctcctggagaaaggaatggctatccactcctatattcttgcctggagaattccatgtacagaggagcctggcaggctacagcccatggggtcacaaagagttggacatgacggggagacccattttcactgtcaagaaaaaaaaaatctcattaaaagatcatatagcttttatggttttcaaggctaagacttgggaaatatgttaccagtggctttccagaaaaatgtataccagagttacatctttctcagtccttattgacactgaccactactattgtaattaattaaatccctttgttaatttgatacgtaaaaatgatgatgatcttcagcatatattgaaattctcttttgtatattctgcacaattcaaaacgtaactgtccttatgagccactattttcaaagagataggtcatactccccaacaagggaattgtacaaacctactgcaaatttatgtgactgataactgaatagaacaattagcttggattatataggatcataaaagctgtcaccctactttggcagacttacaacatttcccaaagaaagagtcgatctccatcaggctgtaaattagatcactgattatgtttcaaggtccaacagaatacctaactgaattcatcagctcaatttattgatagattaacgtttggaattacattgatttctgctcgtaattgaattttaatattttagtcagtgggatccactgggatattgaacattttgaattatttgatgattgcattttaaagagtgttcagtaaaaataaaaataaagccaaaaaaagagaagacagtgtttgatgcctataattttttgaagttaatataaacatattttctcccttattcttttttttttttttttttcagaagaaacacaaaatttgtcatttggtttcccagacctgacatatggtagaaagcactcctgtgggagagtccactgtcactgcatcatcagaagctcctgaactcaaagtctttctcttcctgctctttctcctcaaaaatgctgtcacacctttggcctgagcatcactgcaccaatttaaggctataccagtttattccaccattctagtatagcctgttaatcgtttgataaattgctttgagcaagttaaataaaattagatagcaaatatataatacaattttacatataataacataccattttgtgagccacaatataataatatgttttccttagacattcttaacgtgtagaaaaacatatgacatcacttaattttgtgtttaaacaatttctcagtagaactgtaattatgcaggtacatattcccactgggaattgggtatcagtgtgtgttcctgggatctgatgtgaaatcagaaaactagtctcaaaagcctcagagaaatataaaaggtcttgaattatcctagggaacagcagtcttcctgagggaagcacaaatttcttctacaaacacagaaggccattcaaatcagataatttaaaaatgtacagtaggtcaatttttctcttttaagtatcaaaattgacttttcctgtgaaaaatgaaccactgctgacacagtatagagagaaggtgaatgaaaaagatagtgatcttaccttaatcccaggatattagaacttgatgggattttaagttcttttaagttcatagtcatttattctacatgtagaaactgatagtttgataataaatattccccgagtaacacaagttttaaatgatcaagatacgtctaacaaaaacaatagcagcaaaaaggcccaaatatttgacacatgatattaaatcaattctcactatattggactctgattaagaatctaaatgttaacactgttctaatcacctattatttctttttaaagcatgtacatatccattaaggctgactcaatctatttattatattatccatcttctcttaccgtattgcattgatgccatcaattatcaacacccaagtaatagtactggggtggggttgctgctgctgctgctgctaagtcgctccagtcgtgtccgactctgtgcgaccccatagacggcagcccaccaggctcccccatccctgggattctccaggcaagaacactggagtgggttgccatttccttctccaatgcatgaaagtgaaaagtgaaagtgaagtcgctcagtcgtgtccgactcttagcgaccccatggactgcggcccaccaggctcctccatccatgggattttcaaggcaagagtactggagtggggtgccatggggtggggttagaggaatgtttttaagggagtaggaaaaaaaaaaaagtagtgactagtatcaataaagagaaattcctgcaagaatagatgattttgctaaactcttccaaaatcctgttttcatgctcacctgccaagtacatagaaacatagtagttggctcctaaatggtgtctgttttttatttcctgtattattttccttttccatttgttctatttagcttttatatttcttttttgaatcttgaaattttctttcagacttgaagtgtgtaataaacttgaaatattattacacttaatgttctctatataaattgttctcttcaggtcctgcacatctgtgaatagaaatatgaggtttggcagaaaaacacctcagcaaagaagtgtttgtttctcatggtcaaagcctcaaacttatttaaacattgtccctaaagacaagtctctttatttgatgtcttcccctacaatgcaggagaccccaagttgatccctggttcaggaagatcccctggagaagaaaatggcaacccactccagtactcttgcctggagaatcctatggacggaggagccttggtaggctacggtccatagggtctcaaagagtcagacaccacttcactttcactttcacctttgaatagtcatttttcattattacaaaagaaagaatagctcagaaaagatataattgtatctttttcttgccttcagagagaggcaattgctccactccttaatcaatagacaatcttgtctctatgtttgcagaacaaagcagatgggctatcattcaaggagagttaatattttctaaggaggaagccatctgtatttcataaaagtataattccaatgaattaactagtagatcagtgatgctttccttctttgcttaaccctttgcttagaggaaaaaggaatcctgattgataataaaataatatgtattaatttctcaagaagttcaaacttgtctcaatagcttaataatattagcttccaagatggcgcagtggtatagcatccacctgtcaatgcagggggcagaagaaatttgagtttgatccctgggttgggaagatcccctggaggaggaaatggcagcccaagccagcattattgcctggaaaattccatggacagaggagcttcatgggctacaatccatggggttgcaaagaggtggacacactaaacacacacacatcacacattgaatatttgctgtgtgaaaaacactattgaaaatacacatattagctcatttaatcctcatcattgtctaccctgtagacaagtgtcactataatatgtaatttacatatcagaaaatgaaatcatatagttgttgaaatgttgctgaagtcatacaaatatgaggtgaaagagccagacacatgggatttatcatccatgcgttcaaccaccacagcacatcttctctgatactgtgtcaaaagatgtaaacctgttggagcacaaactctaaatcaagatttatgctagctttaagctaatatccatatatccaattcagcacattgagttttggggaataactgtcttggttaggctaatcttttaagtaccactgtctctaacatttccatttctggggaggtagtatttattgaagagtgcccagtgatccagaatgttcaaactctggccctgactctttgattgcaaagttatgcaatcctggattgttaactgggttgaaatcatcagttcctcttcagtagaggtggccaacatattttaaagagctgtgagaattaagttagatgagaaagcactttgaaaattataagatggcaatgtatccatgccagattttcacatttactctaatttatatctttcatctcctgcattggcagacagattctttactactcaagtgacctgggaagctgttaatttagctaacagaacaaatgtagaaaaatagacattaagtaatccagaatctgcaatcataattgtatacatagttgattttctatacccaaagaatagcttggtaaatagttgcattatgcctattaattctaaatgtacgaaaagtttcaaaagacattcagttttattaaaaatctggaacaaattgagaaaaaacaggaggataagattttggtaatgtggttagatcataatctgagatagagtatataaaatgaaaatgaaaatatattcaaatcagacattatgcaaatgctgaacttgtaggagctgtgtgtgatgtgcgttgttaaggaagaattatatatgtatgatatatatatatacacattatatataacataaaatgtgtatatatgtatgtctatatatagatatatgtatatatgggcttccctggtggctcagctgataaagaatccacctataatacaggacatctgggttcaatccctgggttgggaagatcccctggagaagggaaaggctacccactgcagtattctggcctggagaattccatggattttatagtccgtggggtcacaaagagtcagacatgactgagcgactttcactttcactatatatgtacatatgaactttgtacttatataaaatgtgcacatgtaaaagattttacttatttcattcattaagatgctataaatgttacaaaagataattcaaagaatcacaatattataaatcaggaattcacaaataaactgataatagatacaaaactgcctttccactacagagcaaatcagttgtctctggaaaacaatgtacctgtctataaacaagtatcatgtgtgtttctctgggctatttacaatttacagagctgtagactagtgcaatggcaagagaatgcagacatcattaagagaagggggtaggtgaccctttttaaacatctgttacaatgtatcattaaacattgaaatagtcctgaatactcattatattgcctggattaattcagtaattgtccaagcatgaaaatttctctagttagattccatagcttggcttatactctaaaaaataaaaaatggatgtactacctactattaatatgttgccaactttagaacggtgaatcaatgagatgctaaagatatttaactgtagaagaaaatcatttaacatataatttgatgagacaggcactgtcattttcatactaatgatgatgaaacttaaacttagtgattacttggcctgactaaagaattgtaaccgctgagcattagagttaggattcagttactaattctgttactgattcagtaactaattctgaatattttctctttctattttacaagcaactcttagaagttccttttttcctcagaggcaaaatgcttctcaatgtatgagagataaagtactttgactcctctaactaggcaaggttttgactgaaatagaaatactttaacttgttgtgcaagtaaaaaaatactgcaaagtggaacagaagtgagttactcagagtgtgctgtatgcaatgtgattaaccatgatcattcacattggtgaaagatgagagagtaaatgaaagtaagaggttcagaggttagagttcacccactggttgatgctgtgtcatttaatgtggaaaatgatagctttaagaaatagaagtggtaagttgtcagttcaactggaaatatgtacatttttggtgcttactgttcatatgcctaggggttaccaggatgcccgtggatttagaattaatgttctaattactttagccattttcatatttattttttctctgactcttcaggttattataaacatcagtaccctgtcaaaattccaacctccacaaaccctgcagagaatgcaggtggagaacagctctgtgaagacacagttctttctcttgggagtcagtgaccacccagaactgcagagtgctctttttgctgtgtttttgtccatctactctgttaccctgttgcgcaaccttgggatggttttattgatcacagccagtccccctttgcacacccctatgtacttttttctccacatcttgtctttcgtagacgcctgctactcttcagtcattgcccccaagttacttgtgggcttaatttctgataagaagaccatttcttacaatggctgtgctgcacagttatatttcttctgctatttggaggacatagagtcttttctcttgactgtcatggcttatgaccagtacatagccatctgtaacccctgctttacaccattattatgtccaagaggatttgttgccagcttgcaattggagcatttctgggaggcaccatgacctcaatcgtccacaccacaaatatatttcacctgtctttctgctccagtgaaattaaccatttcttttgtgacacctcccctctcttctctctgtcctgcactgacacttacatccatgacattgtactggtggtctttgctagtttagtggaagccctctgccttctaatagttctcctctcttatatcctcatcttagcacccattcttaaaacaggttctgcagagggaagaagaaaaggattctccacttgtgcttcccatctgaccgtggtctctatctaccatggtaccctgatcttcatttatttgtgccctggcactgtccattcaatggctattgataaagtgacctctgtgttctatacattgattatacctatgttaaatcccttaatttacagccttaggaacaaatatgtaaaaaatgccttcaggaaaatgattagcagaaaatttctttcttaggataaaactgaggctgacagcttttctaccctgtttcttttttatttaatttaagtatatttattttaattggaggctaattactttacaatattgtattggttctgccacacatcaacatgaatctgccatgggcgtacatgtgttcaccatcctgaaccccctcccaccttcctccccataccatccctccgtgtcatcccagtgcaccagccccaagcattctgtatcaaacctggactggcgattcatttcttatatgatattatacagatttcaataccattcccccaaatcatcccaccctctccctctcccactgagtccaaaagactgttctatacatctgtgtctcttttgctaccctatttcttgacttttgttctctaaatctctaaagattctgagtgctgaagctctagtactttgacataagttcctataacctaccagtacaaccttctgaatttcccattattttcaattgtgcctaaattgagtgtagggagcaggccttaataatcttaatcttctctccaaactaaggaagagtagcaatagggtctctgctgttttgcacaaaaggtgttttttacatctctttcctctgttcctgagaggccctagtgaggtatcatgagaagagcaactgctctatccatgtcaattaaacttacttccctaaaggctccattttttttttttaacaataggcttaatagacttgctcagtcagtgttactgtatcagattagttttgtttgtaccctttttatgtgcttacatcaccctgtaaatattccatcataacacatagaaataagtagtaaataaataaataagaaccctctctccatgtctaaatattccataaaagcatgacgcttactatcctgttccccattttttctactatgccacttacagtgtttgatctgagaattcaatttgaaaatacttattgaacaacaaatgtatgagtgtagccagaacaactaatataagattgaacctttgtaaaatgatcaaaaaaattgttcttttctttgattttatcctaccatgttcactttaggtgaaatctatttgcatatggtttcttttgccctatacagaaatgagagtcagagacaggaattatttgttataaaactcttcattctgccttatttcctcttcattctgccttaattatatcagcaaacatcccctgatcctccaaagaacaccaaagaggactcccatctccccactgggttcatagcattgcagtagttaataatgaaaataagtaagcaaataaactgaaaggccccataatatagttcatatcataaaccatatatgttaaatcatatattaacacaaatatagttccctttgcaggggaggaacaaagtattagttatattagaatgctatatatagtgattatgttatctatgaaagtatgaaataaattagaatactcttctaaacaaaattttaacagtggttatcacaattgtgtagtgctaaattattgtatgctagttaatccctgaaatattttccaaaagcttaattaattgcatattctgttctgcctgtattcaattagcaattaatccagttgtgaaaacaacacaatgtaaagttctcagaagcattcattttatcttaggttgtggccatgaaaggaacatggaggcactctttataattttaggagagagcaattgcttatacagatttttatttaggttaggttttgttcacttatgttcaatatccctttggtgctgatgatgttataatcaagatatcatttgaaggaaacaacatattaaaaaacttggaattttcagcagactatttgaattagaattctaatatgaattggaattttagacaaacatattttattgtttcttcaatattttctctcatgatttcaagttatttatagttcatagaatatagcacatttcaggaactctcaatcactgtctaaagctcttcgcaacccaatgaaatttattaagaacatatgaaagtatttatatctgcaaacattaggcttctcaggtggtcctgaaatttctagacagtgtaagactttgaaacctcaattcctgttttgttttttaatttcaatttttttcttctcaattaagcatctccctttttccaatttccaggcattcagaggaatgcctccctggtctggtaagtcatagaacattcagaccaggacaatacaatcatgaactgctgtttagtctatcaaggagaaaaggtccaggtagacaattagctcctaaacatatatatctagcccctaaataatagccttgggtcttaagaaagtgtcaaggaacagtgtcacaatgtctggaaaacctgagaaacttagggatccaagaaagccataaaaatgacaaactggatgttgtgaagtttaaactaattggtcaaaaatgatgcatattaaagttacaagtcagccaaaaatatgcagatcaatactaaaaaatatataaagctgttgtaatccccaccttttgggggctcttctctccttgtcagtgtctatgctaagggctttgcatctctatcttctaaaataaactttgcctgtgttgagtgtttgctagtttgtggagttcattcctcggctccaagaacagaatctggtttcctgtttcagcaccagtgataagaaatcagcctgccagtgcaggacacgcaagaggtgtgagttcaacccctggattgggaaggttccctggaatgtgaaatggcaccccaccccagtattcttgcctggaaaattccatggacagaagtgcctatggctcatcgggttgcaaagagttggacatgtctgatcattataataatgaagcccattcatatcatgtaaaattagcttcactgaccatttttcaaatatatatgtaatgaaaaaaaatccctgttctatttttatcttttcaaagttttgacttaataatgtttacagaggatcaggaaaatgggttgtttttgtttgtttgtttgttttggttttgatttatgctcatttcgagaaaatgatgaagatggaagagagtttaaggtaataagatttgaagttgaagaagatttgaagattgaagacctgagttcaaatcttaaatatactaccttttatttgttagacctgtgaccttagccaactaactcctcatcagggactaaattctggtattgaaagaaaagatggtgtagtttatcacatgaggtcacgagatggagtctgccggattcatctttcactttatagccagctcactgggctcggatgatcccctggagaagtgaatgccaacccacaccagtattcttgcctggagaatcccatggacagaggagcctggcggctacagtccatggggttgcagagtcagatacgacttaagtgacttagcatgcatgcatgccagtcttagagattctagttgcacatctcagctgcagctaatatctggagttctctgcccagaaccctaaggactagcttctcctgaccctgccttccctcctgctagagcttagcagagatttcttcacagtgacctatgctggccacaccattttcaatcttggccagatgcctgaaaactaccttaatggtctaatttccagatgtcacaagtcccacctcactactgatttctgtggacaaaacccttcttgtaaagttagtttctttactgccatgagtggaattagatttataacccagtacacatttttattgttagaagactttgctctctaattcatcctctcacacactattcaactaccttatggtttatcgctgactttagactctccacccacactctttttactggccactgctcagctgtcagtcagactatcatctcaccatccatctgctttagttcccatctctggacctcagaggatgccctttattagaaatgttaactgcttaccaatcaaagtgagagggtaacaggcaggaaagccaggggtctctaaatggagaaaataacccacaagtgttagacatttttatctctcttaagcggcaggaggaaacaaactagtgatattttgtccttctctatacaaatttaaaaggaggtttctcttaaaatactgtgttgccataagcacacctggtttcacctgaagttaactattctcaaacctagagataaccaatgcctttttcttatggaaatgtttgtcttcagctatgctaatgtactatgcgtttaccccaaactctgtcatcaagtcggttctgcctcttggctcagaacctacttgaaaaaccagtatgttatactcagatatagttcccctaatctatgtaaatgaaactattcgtacggtggtctgcccttcttcaagattcaagttaatcattttatggcccaggataaaccatttggtgccaagattatcccaaaatgcatcttatgggtgaggggcctggtgccattctgaattttaagacattcctttctttcattaacagactgctagtgactatataacattcagctgaagattagcagaggggtactcttctgcccccttctgatgcctatgtcagaagctttctctatctcctttatactttaataaaactttattacccaaaagctctgagcgatcaagcctcgtctctggccccggattgaatttttctcctccgggggccaagaatccccgtgtcttcgcatgattcagcaacaacctttcaaagggatttcagactgtatatatttttgagaaaaatattttacaagccagactttgatgaagttgatatttccaggctgccttatttttttttaatccacatattcacaatatctttttttttaatataaatttatttattttagttggaggctatttacaatattgtagtggttttgccatacattgacatgaatctgccacaggtgtacatgtgtttcccatcctgaacccccctcccacctccctccccatcccatccctctgggtcatcccagtgcaccagccccgagcaccctgtatcatgcattgaacctgaactggtgattcgtttcacatatgatagtatacatgtttattttcccaaatcattccaccctctccctctcccacagagtccaaaagacttttctatacacctgtatctcttttgctgtctcgcatatagggtcattgttaccatctttctaaattccatatatatgcgttattatactgtattggcagagaaggcaatggcaccccactccagtactcttgcctggaaaattccatggatggaggagcctggtaggctgcagtccatggggtcactaagagtcggacacaactgggcgacttcactttcacttttcactttcatgcattggagaaggaaatggcgacccacaccagtgttcttgcctggagaatcccagggacaggggagcctggtgggcggccgtttctggggtcacacagagtcggacatgactgaagcaacttagcagtagcagcagcatactgtattgatgtttttctttctggcttacttcactctgtataatagactccagtttcatccacctcattagaactgattccattgtattctttttaatggctgagtaatactccattgtgtatatgtaccacagctttcttatccattcatctgctgatggacaactaggttgcttccatgtcctggctattataaacagtgctgagatggacattggggtacacgtatctctttcaattctggtttccttggtgtgtatgcccaccagtgggattgctggtcatatggcagttatctttaaataggcatgtgcgtaatatggtacccttctgaagaatgagctaaaaactgcaagagaaagaaacagttgctgtctattatgagcatataatctgaattaaaaacagtcaatataaaaagaaaatttttttgactatgtctcatggcttttgggatcttagttttacaaccaaggattgaacctgaaccccctgcaatgaaaaagcagagtcttaaccactggacagccaggaaattctcactaataaaattatttttatttcataaaattttactcattatatgcactggggaagataatgtgataaagatgcaagggttccaattaaaaaaaataatgaataaattcaatagtagaccaccttaactgcctcctgagaaatctgtatgcaggttaagaagcaacagttagaaccagacatggaacaacagactggttccaacagggaaagaatacatcaaggttgtatattgacaccctgcttatttaacttatatgcagagtacatcatgagaaatgctgagctggatgaagcacaagctgggatcaagagtgctgggagaaatatcaacaacctcagatacgcagatgataccacccttatggcagaaagtgaagaagaactaaagagcctcttgatgaaagtgaacgaggagagtgaaaaagttgacttaaaactcaacattcagaaaactaagatcatggcatcaggtcccatcacttcttggcaaatagatggggaaacagtggaaacagtggctgactttattttggggggctccaaaatcactgcagatgatgactgcagccatgaaattaaaagatacttgtttctttgaagaaaagctatgaccagcctagacagcatattaaaaagcagagaaattactttgctaacaaagccgtggtttttccagtagtcaggtatggatgtgagagttggacagtaaagaaaactgagctctgaagatttgatgcttttgaactgtagtgttggagaagactcttgagagtcccttggactgcaaggagacccaacgagtcaatcctaaaggaaatcagccttgaatattctttgaaaggactgatgctgaagctgaaattccaatactttggacacctgacatgaagaactgactcattggaaaagaccctcatgctgggaaagattaaaggcgggaagagatgggacgacagaggatgagatggttggatggcatcacctacgcaatggtcatgaatttgagcaagctccgggagttgctgatggacagggaggcctggcgtgctgcagtccatggggttgcaaagagtcagacaggactgagcgactgaagtgaagtgaaatttaatacaggggcataactacagacacaaatgacattattataaaatttagtgaggtttagaatatgagttatatcataattgaaatggatggcagggaaaaaaaactaatgtagcatttaatatttgagggaggcttcttctttattttcttttcttcctgtcttttttttttttttttttttttgagaaagcctttttagtgtgagtacaatttggacagttaagcttcaatctgcatgtggttgctgttgtttagtcactaagtcttctctgactcttctgtggcctcataggctgtagccatgttcttctctccatgcaatttcacagttaagaatactggaataggttgccatttcttcctccaagggatctttctgacctggagatcaaacctgtgtctcctgcatttggcaagcgggttctttatcactgagcctcagagaagcctctaccatctacacatactgccatggaaatcaaattaattaacaaagaatctcagtgaatttcatttataaattttcacaaaagagtgctgcaatatatatcaaaagcttaaccaatattgagtaaaatgataataacaaaatgagagacaaagagtaagaatatgaaatatagaatattacatgaagggtaaatctactcctgagaaaaaaatatgaaagttcaaatttatttcatttagcctatttcctattggtagatatttagattattttcaatagtttgcccctgatgctgggaaagattgtaggcgggaggagaaggggatgacagaggatgagatggttggatggcgtcaccgactcgatggacatgagtttgagtaagctccaggagttggtgatggacagggaagcctggcatgctgtggtccatgggattgcaaagagtagtacacaactaaacaaatgaactgaactgaactgattataagctctgatgcaatgaatactttgaaagtggtaaacttttgcaggttcaattgctagaattactggtttaaatgatacctgcatatttaattttcaaattccaggtgagttacatatttcattcaaataatagcaaattatcttccataaagaagactaaacttccaccaacaatgaatgagtgtggaaaaaaaaaaaaaaaaaccttaaaatgataaagaattagacatatgtaacaaggcctggctctaacattagcctctggcccaattttatagttgaggcttcattgcctgtagaattagggaacacccatactaaactgacttttccattagttaaaaccaaaggtcaagaaacagggcagaaaagttgtcagcctcagtttcatcctttcttaagaaagaaatttcctgctaatcattttcctaaaagcgtttttcacatctttgttcctcaggctgtaaatcaagcggttcagcataggtataatgaatgcatagaacacagaggtcactttatcaatatccagtaaatggcaagcactgggatgcaaataaatgaagatcagggtaccattgttgatagagaccacaatcagatgggatgcacaagtagagaatccttttcttcttccgtcagcagattgtgctttaagaatgggtgctatgatgaggatataagagaagagaactgttagaaggcagagggcttccactaaactagcaaagaccaccagtacaatgtcatggatgtaggtgtcagtgcaggacagagagaagagaggggagatgtcacaaaagtaatggttaatttcactggagcagaaagacaggtgaaaggtattagtggtgtgaatcactgagctcatggtgccccctaaaaatgctccaattgcaagctggcagcaaatcctcttggacataataacagtgtaaagcagggggttgcagatagctatgtactggtcataagccatgacagtaaagagaaaaggctctgtgtccaccaaacagcagaagaaataaaactgtgcagcacagccattgtgagaaatggtcttcttatcagaaattaagtccacaagtaacttgggggcaatgactgaagagtagcaagcatctatgaaagataaaatgtggagaaaaaagtatataggggtgtgcaagtgaggactgattgtgattaataaaatcatcctaaggttgcccatcagggtaacagagtagacggaaagaaacacagcaaaaagaacactctgcagttctgggtggtcactgactcccaagagaaagaactgtgtcttcacagagctgttctccacctgcattctctgcagggttcctggaggttgggatttcagcagggtaccaatggggatgttgataataatctgaagagaagctacaaaggaaaataattaaagtagttagaatagtaattctaaatccacttggcaccatcataacacttgggcataaataaagtaaatttagtataagcatagcttttcaactgaaatactttttttttaattagttaattgcttttttttttttttttaatgtttggcagagacatgtagcttgcaggaccttagttccctatgagcaatggaatccatctactttatattgaaagcacaaagtcctaaccactggatggccagggaattccctgagatagtttatttaattgaattgattgtttatacttctatttcttaaagctatatatatatatatttttttttttccccctcattaaatgagacaccatcaaaccagcgggtgaactctgaatttcttacttttatcaactctttcatctgtcaccaacttcaagtgattggggttagttacattgatacatagcaaactgagtaactagcctctcttttcctttgtggtatttttgttaacacaacaaatagatacatttctatttcagttgaagccttatacatgtagaggagtagaagttctttatttctcaccttgagatgagaatttgcctctgaggactaaagaaactaaagtttcttgaaatacactgatgaaatagaaggaggtaagattcagaactagttatataagtaactaaatcctaactctgccacttagcagttataaagtcttcagcaggccaagtaatcacagaatttcagcttcatcacctataaaatgaagaggacagtgccttcctcgtcaaatcggagaaggcaatggtaccccactccagtacttttgcctggaaaatcccatggatagaggagcctggtagcctgtagtccatggggtggctaagagtcggacacaactgagcgacttcactttcacttttcactttcatgcattggagaaggaaatggcaacccactccagtgttctttcctggagaatcccagggacgggggagcttggtgggctgccgtctatggggtcgcacagaatcggacacgactgaagcgacttagcagcagcagcagcagcagcatcaaatcgtattaaatttccttctaggctcaatatcttcaccatcttgttcattcactgttctaaagttggcaacacagtaattctgcagaattccatatatctactttatgttatctgaaatccaagctatgaaatacaactagagaaatccaaatgcttgcatatttattaaattcatctaggctattcaataatattcaggaatattggatggcccctttgattaaaatgataaaagatgttataaatgctcaactacccacctctctatgttatctctgtacttccttgtcattgctttagtccacagctctgtaaattgtagataacccatagcaatgcaagtgacacttgtctatagacaggcacattttgcccaggatagagataattgatttctctccccactgatggtaaaaatccagctttacatctatttgtcagtctatttgtgaattcctgatttacgatattgtggttctttgaattatgttatgtacatttcataacttattacgtattgaacaaagtaagtaaaacctttgatgccggtaatgctatatgcattgttattgttgctcggtcgttaaataagtgtttgattctttaggactccagggactgcagcgtgccaggccttcctgtatctcactgttcctgcctataaaagttaaagttaaacatgtgtgcatatatgttatatacacatatatatttttctttaacaatttacattattcatggctcttacaaactcagtatttaaataacttcagatttgaaaacattttcattgtcatctcatattctctgtctcagaacataatctaagcacattactaaaatcttaacctcctgtcctatcttttgttccaagttcttaacaaaactaaatgtcttattaaaactgtgtatacatttagagttaataagcacaactatctgtgaagctatttttggggtacagaaaatgaactacaaacacaataataattgtagattctgcattgttcaacacctatttttctgcatctgttcgtttctgcatctgcattgtttctaggtagattaggcaaattctgggtaaatgtgtgtatctgacattaatacatttgcatctcataattttcaaagtaaactttctcatctaatttaattctcacagctctttaaacagtgctgatcaactctcagttttatttagaagaattgatgatttcagcccagtgaatagtccaggtctgcatagctttgcaatcaaagaacaggtccaaagtttggacattctgtacactggacattcttcaataaacactaccttcccagaaatggaaatgttagaaatggtggagcttagaagattactgtaaataatatagttatttccccaaaactcaatgtgctcacctgccagggaagtccttggtcacttttttttttccttttattttaatttctttaagcttttttattttgtattgaggtatatctgattaacaaacaatgttgtggtagttttaggtgaacagagaaggactcagccatacacatgcacgtgtccattccccctcaaactttcatccatccaggcagccacgtaacattgcacagagctccctgtgctatccagtaggtccttgctgattgtccatttttactacagcagtgtgtgcatgctcacccccaggtcccattctcctccccctactcttttccactggtaaccataaggtcattctctgagtctataagtctctttctgtttttataagttcattgtatcaactcttcttaggttctgcatgtaaaggatgtcatatgatatttctccttctctgtctgaattacttcactcagtatgacaccctctaggtccatccatgctgctgcaaatggcactgttccattatttttaatggctgagtaatatcattattttttaaaacatttttttccttctcccttaaagtcagccctcttatctgcctgaagccttttacttgtgtattgacagttgttgggatcaatgcattaccataagataggacaaataatattaaaaaatcagttcagctgtaattgatatatagctccatccattcttaaaaataaataatatataacgagcacagtgttcattctgattcctagtcagagtccagtaatggtgaggtttgttttaaggttggctgctgttgttgtttagttgcaaagtcttgtcctgctcttttgcgaccctgtggactgtagcccaacaggcttctctgtccttgcagtttcccaggcaagaatcccggagtgggttgctatttccttctccaggggatattcctgatacagagatcaaacccatgtctcctgcatgggcaggcagattctttaacactatcatgtgtcaaacattagatttttgtttctgctgttgtttttgttaggtacattttcagaatttaaaacctgtattaccctaagtatgtttatcctcaaaacatcagtttctatgtgtaaaataggatcacacactctgatatccaaatcccaatgggaaaacttacctgagcaattagagttctacagaggagtcgagtacacacaaaggaaatgatgtaatgtgtttttctatatcttaagaacatctcgagcaaaaatatattatgactttcaaaatggtagattgttatacataaaattggaggatgatagttgctatctgatttgacttgttcaaagcaatttatcaattaatagaagttctatgtgacagaacagtggtgaactgaaatgaagccaaatatatccatacacgaattgagaattagaaggtctttaagtaaacattgttaactaaaaaataatatagttacaacctgtaaggagacatttcacttgatgggaatgttaaggactttgagaccaggaggcagcatcagtagccatgagaaaaccactcaaggaggcaggaggcggagtcaggctatacacaagtttgcaaccaaggggacagagaatcggaacatcagagattattgtgaggtagagaaaatcagatatcaagttaaggagttaatttttcttctacatatggaaagatgcaagcctctgggctcactgaattcattcctttcatatgtaattcagctcagttcagttcagttactcagtcctgtccacaccccatggactgcagcatgccaggcttccctgtccatcaccaactcccagagcttgctatctgggccaaattctgtctcctgattgtttgcatccttaattcctcgctcaccttaaggcgtagccgatgtggcagatggctgctgcttgcattccctgagctctcagcaaacacctgtgcgggtggcagcagctgctggcgcgcagttttgggagccctcattcacatttggaggccagaaatcatggatagttgtgacatttcttgtttatggatatgacagcagacatttaatttcaccacatgagaaagtcaatgatgaatgaaattgactccaatatgtgttgtctgtgcatcacattcaagtggaattttggccatccaaggtcagaattgacctgataatcttaatacaaacatttactctatgtatgtgtgtcagctggtgttctggatacaaaacagagaaagggaggatacatggaactccatatgaagaatttggcaaatggaatactgaacgagagacaaaacaggaaaaaaaaataagaaattgatgggagattgaaaatttcatggcgtgatcgaagtattgaaatgagatttacagcaatgttgcctctgtgtatgtgtgtgtgtgtatgggcttccttggtagctcagtgataaagagtccgcttgccaatacaggagccacaggagacaggggttcgatctttgggttgggaagatcctctggaggaggaaatggcaacccactccaggatccttgtttggataatccaatggacagaggagccttgtgggttacagtccatgggatcacgaagaataggacaaatgaaatgacacaactgagtgaacacatacacagtaaaatgaagcacaaaaatattataaatgaatgaaaaattcacacgaattcttacaatttgcaggtaagagagtggccagattatttatgtgaagccacataaagaaatatagaagaacctttctgtgtttgctttacagacaagtcggaggagcagtcagtgcacccccattactccagatggggcagaggggagcctcgtacagtggacggtgcactatctataaagtgagccctcggctcacccatggcagtggaaactacactacagagagggttctgtctatgcagatcagtggtgacataggccttggcaaatgcggtcgtccaatggggaagaaggaaatgacagcctgagggtgatgaaaaccaaatgctttgtcttaaacagcagaaaatggtgttgggaatgcaagtgtgtgctaaattaattgttttttccttcattggcaggcagattctttacctacttggtcaccagtatatataaatatatatataaatatgggcttagcaggagacactggtttaatcactgggtcagaaagatcccctgaaaaaggaaatggcagcccactccagtatatttgcctgggaaatcccatagacaaagaagcatggctatggtccatgggataataaaagagtcacatgtgacttagtgattaaataacaacaaacatatgcaaaaaaagtgatatgaatcactttgctgtacacctgtaactaatacaactttgtcaatcaactatcagatcagatcagatcagatcagtcactcagtcatgtccaactctttgtgaccccatgaattgcagcacaccaggcctccctgtccatcaccaactcccagagttcactcagactcacgtccatcgagtcagtgatgccatccagccatctcatcctctgtcgtccccttctcctcctgcccgcaatccctcccagcatcagagtcttttccaatgagtcaacgcttcgcatgaggtggccaaaatactggagtttcagctttagcatcattccttccaaagaaatcccagggctgatctccttcagaatggactggttggatctccttgcagtccaagggactctcaagagtcttctccaacaccacagttcaaaagcatcaattctttggcgctcagccttcttcacagtccaactctcacatccatacatgaccacaggaaaaaccatagccttgactagacgaacctttgttggcaaagtaatgtctctgcttttgaatatgctatctaggttggtcataactttccttccaaggagtaagcatctttaaatttcatggctgcagacaccgtctgtagtgattttggagcccagaaaaataaagtctgacactgtttccactgtttccccatctatttcccatgaagtggtgggaccagatgccatgatcttcattttctgaatgttgagctttaagccaacttttttactctccactttcactttcatcaagaggcttttgagttcctcttcactttctgccataagggtggtgtcatctgcatatctgaggttattcatatttcttccagcaatcttgatgccagcttgtgtttcttccagtccagcgtttctcatgatgtactctgcatataagttaaataagcagggtgacaatatacagccttgacgtacttcttttcctatttggaaccagtctgttgttccatgtccagttctaactgttgcttcctgacctgcatacaaatttctcaagaggcagatcaggtggtctggtattcccatctctttcagaagtttccaaagtttattgtgatccacacagtcaaaggctttggcatagtcaataaagcagaaatagatgtttttctggaactctcttgctttttctatgatccagcagatgttggcaatttgatctctggttcctctgccttttctaaaaccagcttgaacatcaggaagttcacggttcacatattgctgaagcctggcttggagaattttgagcattactttactagcgtgtgagatgagtgcaattgtgcggtagtttgagcattctttggcattgcctttctttgggactggaatgaaaactgcccttttccagtcctgtggccactgctgagtttcccaaatttgctggcatattgagtgcagcactttcacagcatcatctttcaggatttggaatagctcaactggaattctatcacctccactagctttgtttgtagtgatgctttctaaggcccacttgacttcacattccaggatgtctggctctaggtcagtgatcacaccatcgtaattatctgggtcgtgaagatctttttttgtacagttcttctgtgtattcttgccacctcttctttatatcttctacttctgttaggtccataccatttctgtcctttatcgagcccatctttgcatgaaatgttcctttggtatctctgattttcttgaagagatccctagtctttcccattctgttgtttttctctatttctttgcattgatcactgaagaaggctttcttatatcgtcttgctattctttggaactctgcattcagatgtttatatctttccttttctcctttgcttttcgcttctcttcttttcacagctatttggaagacatccccagacagccatttgcttttttgcatttcttttctatggggatggtcttgatccctgtctcctgtacaatgtcacgaacctcattccatagttcatcaagcactctatctatcagatctaggcccgtaaatctatttctcacttccactgtataatcataagggatttgatttaggtcatacctgaatggtctagtggttttccctactttcttcaatttaagtctgaatttggcaataaggagttcagggtctgagccacagtcagctcctggtcttgttttggctgactgtatagagcttctcctttggctgcaaagaatataatcaatctgatttcggtgttgaccatctggtcatgtccatgtataaagtcttctcttgtgttgttggaagaggatgtttgttgtgacgagtgcattttcttggcaaaactctattagtctttgccctgcttcattccatattccaaggccaaatttgcctgttactccaggtgtttcttgacttcctacttttgcattccagtcccctataatgaaaaggacatcttttttgggtgttagttctaaatggtcttgtaggtcttcatagaaccgttcaacttcagtgtcttcataatacatgtatatataacataatatatattatatttatatataatatataacaatataataaatattataacaatatataatatataataaatatacacaaaataatatataatgtataataatataatatatattatatatataattatatctatataattataaattatctgtataaatatatctataattataaatataatatataatataatatatataatatataattatatatttaataatatatatcttaaatatattatatattatttacatatatttaatatatatgtaatatacatgttttatattacacgtaaattacatatatattaaatatatatgtatatttagtatataatatatttaatatattatattattaaatatataatatatcatatattgtatttataattatttaattatacatattatacattgtatatgtgtgatatatacacattatacatattatatatatatgtataatatgtatacaattatacatattacacatatgtatacatataatatatacgtattatacatatataattatatatatctcgagtgatctgatctgatctgataatatattatatatattatcagatcagatccttcgctcagtcatatctgactctttgcgacctcatgaatcacagtacgccagtcctccctgtccatcaccaactcccggaattcactcagactcacgtccatcaagtcactgatgccatccagccatctcatcctctgttgtccctttctcctcttgcccccaatctctcccagcatcagagtcttttccaatgagtcaactcttcgcatgaggtggccaaagtactggagtttcagctttagcatcattccttccaaagaaatcccagggctgatctccttcagaatggactggttggatctccttgcagtccaagggactctcaagagtcttctccaacaccacaattcaaaagcatcaattcttcggcactcagccttcttcacagtccaaccctcacatccatacatgaccacaggaaaaaccatagacttgactagacgaacctctgttggaagagtaatgtctctgcttttgaatatgctatctaggttggtcataactttccttccaaggagtaagcaccttttaatttcatggctgcagtcaccatctgtagtgattttggagcccagaaaaataaagtctgacactgtttccactgtttccccatctatttcccaagaagtgatgggaccagatgccatgatcttcattttctgaatgttgagctttaagccaacttttttactctccattttcactttcatcaagaggcttctgagttcctcttcactttctgccataagggtggtgtcatctgcgtatctgaggttattgatatttctcccggcaatcttgattccagcttgtgtttcttccagtccagcatttctcatgatgtgctctgcatataagttaaataaacggggtgacaatatacagccttaatgtactcctcatattatacatatattagatattatattatatattatatataaatatatatatacatatattatgcatatattatatatattataatatatattataatataatatattatacatatatatttatatcatgagaaacgttgggctggatatattatattgtatatatatattaaatatatatatatatatttcggagaaggcaatggcaccccattccagtactcttgcctggaaaatcccatgggcggaggagcctggtaggctgcagtccatggggtcacgaagagtcagacacgactgagtgacttcgctttcacttttcactttcatgcactcgagtaggaaatggcaacccactccagtgttcttgcctggagaatcccagggatgggggagcctggttggctgccatctatggggtcacacagagtcggacatgactgaagtgacttagcagtagcagcataaatatttaataatatatataaatatatatttatatatttataatatttatttatataatatatttatataatatacaatatatttatataatgtatataatattatatacatgttattttatatattatatataaaatattatatacatattatatgtatataatttacatattataaatgtatattatatatagtatatatatacatttatatatgtatgttacatagattatatataatatgtattatattattatatattattgtaatatatattacatgtattatatatattataaaatatacatgttatattatattattgtatattatatataatatatatcattatatatattattatatataatattatgtatatacacacatatatggcaaatttggccatatataaataatatatatattatttataaatattaatgttatatatattatatataatatatttaatatatttataatatatattaatattatatactatatataatatgtattatatatgtagattatctatattatatatattatatgtatattatgtatattatatatattatatatagagtgagagagagaaagacagagagagagaaccccatccttctgttatactttttaaattatcccaaatagaaattattgatagatgcatatcgacatagatacagcacatggtagctggaatattcagtagtgattattgcattcataactctcttttgaccagtggaaaatgaggcccatggaggaagtgatttctttaaggttacagttactgtaaattgagtgttcatacatacacaattttgttgaaactgcttctccagttcatagcttatttctagagaggttttcaagctaagctaaatttgctgcctctgaagaaagaaccacatacttatcaaatcaatgagagctcttacaattttgattcaacaaactctgctaactatctttctaccagtatgagctcatggcttctattattctgtatataacctaactaccatccctggttttgcttatttgtggggataccaattgcagagtagaaagaaagaactgtgagcaaaaaattgacctaagttacaatctcattacacacggttactgaaggaggccatgcaatgagaggctgacaaatgactcagagaggaaattggactggacaatataaagaaagtgttaaactcaaagttgaagttgagtagtcagggagagggtgaactagcaagagagaagaaagccttcagtattgaaaatgtatgctgtgtaataaattacatcagagttgcatttattgcagtggaaactatctttaacagtagttttttcagaggaagggataagttagaaggttggaatcaacataaacacactactagatataaagtagataatccacaagatcttactctatagtatagggaagtcagtactctgcaataacctatatgggacaataatctgaaaaagaatagatacatggacttgtattacaaatcacttttctgtacaactgaaactaagacaaaatgttaatcaactctaacccaatataaaatagaaattaaaagtaaaattttgccaatacagatcactgtgaaggtaaggtgtgggtaatgctggctttccgtggggaagaatggaatggtagccttatgatgagaatcaagtgtcttgtcctaaatatggaaccagaaatgtcctaagtgtgtgagttcgtcacaaaagatagacattgtttcctttgcagctaaatgtgccatttcaaccatggcccttggggcaggaccagagaattacggatttattagccaaattacttcttgttgaggtgcaaccagggaattgcatcattagtgttgtttcaggcatttgggggagaaggcagtggcaccccactccagtactcttgcctgggaaatcccatggacagaggagcctggtgggctacagtccatggggtcgctaagagtcggatgcgactgagcaacttcacttccatttttcactttcatgcattggagagggaaatggcaacccactccagtgtcttgcctggagaatcccagggacggggggccctggtgggcttccgtctatggggtcgcacagagtcggacacgactgacgcgacttaccagcagcagcagcaggcatttggactgatttgggaatggtgtgcctaacatagatcactgtgaagagacctctgctcaactcggacaaagaatgaatgcagggtcctgaatgaccagtcctacgggcaaagaactccaaacatgatatgatgatgggatgtgtagtgagatctgaaaccctggatgacctgcctctgaagtggataaagatggatcctgaagacaccactcatgacctggtgctgtgaatttttgccatctcatttcagggctcgttcctgagggagttatgaagccttatatgattgtgcaaccttatgtaaaacagcgagttggagcctgctgtacagcacagggagtttgatgtggtgccctgtggtgacctagaggggtgccatcccagagtggagggtcagggtcgatgggggcggtggtggaggggtggggggggtggtgatatatgcacacacataggtgatttgtttgatgcacagcagaactaacacaacattgtaaagcaactgtaccccaactttaaaaaatccagattgaatactcacctctctcacatcttaatcattatgttaaaacaaaaataaacagaaacaaatgcaaaaaaccctggtttccttatcatatgtaaaggcattaatacagtgtcattagataaaaagttaaagggacaaagtaaagtctatctttttttccttaaacatacagtgggtagatggtaaagaatccatctgcaatgaaggagactaaggttcagtccctggttagaaagatctcctgaagaaggaaatccagtatttttgcctggagaattacatggacagaagaacctcgtggcctatagtccatgggctcagcaaaagtcagacactactgagtgactaagcacctcagcaccttatatgtaaatgatggccagagaatccaattttacataacacaaataagcttatttttaataggcatgactatctttaataggtttttaacaaagtacattgaatgtggaaggggtttggacaataattaagaggtactgatatataaaatatactgaggggaaaaaatccattatttgaagttataaaagaaaataggtgggtcatggagaaagcaagggaatttcaaaaaaacatctgcttctgcttcactggctgtactacagtctttgactatggatcacaaaaatctgtggaaaaatcttagaagtgatggtattttgccaaaagtttattgttgttgtttttgccaaaagttttcatttccttctcaggttcaaaggatttgttaacaaagtaacccactcattatacacaattatataatgcagatatttaatagacaattatctagcttactttcaagatactaacgttaacagagcagaggatacatcaccaaactgggttttgaccaacatccagacttaaacagcgctgggagtttccatgtcacagacatctggagtcccaactgggaaagggtcccaggcagtacctccactctgctctgtgggtgagacttcaaagactgtcctgatttcgacttataatcccaggacagactcaaacggatacattcatcaatctgggaccaaattgcaagcctggtttcaagataatgctgttggctttgccatggaaaacttggaacgtggcaaagcctggggcttggttggccagaccccctccaggggctcaactatctcaggattcttccctcatcttatctatggggctgcaagtcttgcactcacagcggtcactcccagtcagggcagtgcccaggtaggttagaagcaaggtcacaggcctgctctgctttgtctctgaagcctaaacaagactatttatttactttctttaacagatgggagtaccagatcactttatctgtctcctgagaaaattgtatatgagtcaagaagcaacagttagaactgtacatagaacaaatgactggttcaaaattgggaaaggggtatgacaaggctgtatattgtcatcctgtttatttaacttatatgcagaatgctgggctggatgaatcacaagctggaatcaaatttgccagaagtatcaacaaccttagatgtgcagatgataccactctgatggcagaaagtgaagaggaactaaagagcttcttgatgaaggtgaaagaggagagtgaaaaagctggcttacaactcaacattcaaaacactaagatcatggcatctggtcccaacgtctcatggcaaattttgttgttcactcactaagtcgtgtctaactctttgcagccccataggctgcagcacgccaggcttccctgtctttcatcatgtcccagagttttctcaaactcatgtctattgagtcggcaatgccatccagccatctcattctctgttgtacccttttcctcctgccttcagtcgttcccaaattcaaggtctttcccaaacatttggctctttggatcaggtaaccaacatattggagcttcagctttagcaccaatctttccaatgaatattcagggttgatttcttttaggattgactgatttgatctccttgctgttcaaggaactctcaaaagtcttctccaacaccacagttcaaaaacaccgattctttggacccagccttctttatggtacaattcttacctctgtacatgacaactggaaaagccatattttgatgactactactaaaattctgtttagaataaagttccagtacacatcgcagatacacagggagccaaatcaatcattgcaaatataatcaattctaaacattaccttgcgtttgtttcttatcttcctgtataccaatacttaaaatgataactttctatttcacttaaaagatagcaattgggctttttccttttttttaaatattaactgaggtaatggctcactggtaaagaatcagcctaataatgcaaatgacgtgggtttaatcccttggtagggaagatcccctggagaaggaaatggtaacccactccagtattcttgccggggaaatcccatggacagaggagcctggcgggctacaatagtgtcacacacaactttgtgactaaaaacgacaacagcaaaaggctcatgctaggaacacctcaagaggtggagttgtgttttccagtgacctttaaagaagacccaggttcttcatccccaacttctaatcatgagtttctgtgcatctgtgaagagcaccgtatctgttctctgcaatattggcaaaatagaacatccacaggatgataaccagtctctgaagtgtaatagcaatctagtacacatgattctaaggttacttagtgatattattggggcagaattataaggaatagactatgcatgaagttctgtcaatccctatgatccctgtgtctgttactcattcaactaagtctggaggcacgaaacagagacgtatttcttttacactgaatacacatctgtgctaagtcgcttcagttgtgcctgactcttaacgaccccatggactaaagcccaccaggcttgactgtccatgggattctccaggcaagaatactagagtgggttgccatgccctcctccagggaatcttccccattaagggatcaagcccacatctcatttctcctgcattggcaggtaggttctttaccatctggaaggcacagtaaatatactagaataaagtgaaacaaagggaggggttcttgctagtgtatttggtaaatttacaaggactcctttgcttaataatgcaaggggtcctcattcatttattcaataagtgtttttgaatggcattctgaagcccagcaatataaatatcaaaatagataataggtgaacaagaaaggaaaggaacttgcatctatcgaggttttaattacaacacatggttttatgtttattcttatttatttatgaatttattttgtatatgaaagtatttattcactgcctctacaattttacgtgctatgatgacacagttatagagtgatacaagtacataaaaagtgtacaaaaaaactatttgactcactaatattctcttattgctgagcaactttattaaatctattgtttaaaaaatgtactggaatcataggatggtaagttgaattgacataagtggagggatagcttggtgaatgctatctcacaggaggcttatccaaggaaagaggtataaaaaagaccctctctgcaaaacagcatattgctcccctttctcagtctggagacaaactaagatcaccaatgactactttcaacactcaatttatgcacaaaggtaactaatgggtaatatccagaagactgtaatgatgagactacaagaatctatcagtacctgaacttcagctctcagaatctttatatatgtagttttggttgaaaacactgtatcactcagaacacaatttatttttttatttttttaaatagattttattatttagagtagttgtaggttcacagcaaagtttagccacaaatacaaaggcaaatacaaagatttctcatacagactttatcccctccaatttttctttcaaaatagaaagatctggcaatgttttgcacatagcaagatttgctttgagcttaagagcagctgtcctgtttactggggctgctgttctctattttaccagtttgcagtcagtcactccctacaagcaattgccttctgtcatgtacattatctaactcttaaagatatgtaagaataaaacttccttgtgaaagaaaatcaccttaacttgttgcaataaaaaatcatacgagaatctgctataacagcttattgaagctacagaaacctacaaaatgtcaatattttgactctataaatttgaactcctaacagtgaacttaaaaattatgtatatcaaacagtcccataattaagggaattttaatttggtacattgtcatataatctataaccagtgattaaaagttacaattgtagagtatatgacacaataaagcatgttacaatttaagaatacttttcctaaatagatagtagcagtcaagcgctctctgtagttaattttccacatagtagtattgatccatacctgctttaaaaaaaaaagttaccacacaggtaatcatttctccattgctagttgaatctgactactcttcctctgctacttctgaatttcttccaagctgtctctcctgcctgctcacctaagccagaaacctggttatcctgttttcacttagtcatctgtgttaccactgcatcatactattctctctgcctccattcttattcccttttatcttccacacaggtgccagagtaacctttaaaatttgaatttgatgatgctattcttttcagtggcttcctaactctcaccagcttctttagcttaatgcctggttgtcacagaagatagtgatgtgacttgtggaaaggtgtcagcagacacaatgggaagtttctttaatggcaaaagatagagacttttagagacccagtgttatttcctactgaagcttttctaattgtcctcctctgtctggaatgtacacttcatttccctggttctgtttcctggggttaactcttatctgacttttaaatgtagctcagatactatttttcccccaaagaccccgtttcccccacccctgtttaggttaagttctttctcctgtgttcctatagctctttgcacatctctgtcattattcaatgtcttctgaagagcagtgtttcaaaaatagctatgaaataagtggtctatgtcaaacagatacagaatacaaaattgagtactctggaatttctaaaagcctttatgctaacatgcctcagcattctccaagagtagggtacagtatgaagcatcttccaaacagagcaatgaaccatctattcaactatttattttaaatttcaagtttcttaattattcactttttaaaatttaattttattttattttttaactttacaatattgtgttggttttgccatatatcaacatgcatctgccacaggtatacacgtgttccccatcctgaaccctcctccctcctccctccccttaccgtccctctgggtcgttccagtgcaccagccccaagcatctagtatcgtgcattgaacctggactggcgactcgtttcatatatgatattatacatgtttcaatgtcattctcccaaatcatcccaccctccccctctcccacagagtccaaaagactgttctatacatcagtgtctcttttgctgtctcggatacagggttactgttaccatctttctaaattccatatatatgcattagtatactgtattggtgtttttctttctggcttacttcactctgtataataggctccagtttcatccacctcattagaactgactcaaatgtattctttttaatgactgagtaatactccattgtgtatatgtaccacagctttcttatccattcatctgctgatggacatctaggttgcttccatgtcctggctattataaacagtgctgtgatgaacactggggtacacgtgtctctttcaattctggtttcctcagtgtgtatgcccagcagtgggattgctgggtcataaggcagttctatttccagttttttaaggaatctccacactgttctccatagtggctgtactagtttgcattcccaccaacctcagaacacaatttagtactgattacttttttaatggcaactttcacatccttatttcttaagctttagatgaatgggtttaacatggggatgacaactgtgtagaagccagaggttattttgtctatgtccatggagtatcttgagttgggtctgaaatgcatgaacaggagcgtgccatgaaatatagccacagctgttaaatgggaggcacacatagagaaagctttgcgtctcccctcggctgagttcatcctaaggatggttgctatgatatagctgtaggagaggaggacagtgataatgctggtccccacaacacaactactggatatgaacagcattatctcattgatggatgcatctgaggaggagagggctagcaaggccaggaagtcacagaaaaagtgattgatgacattagaactgccaaatgataatcaaaatgtacaacaggtgtggattgctgaatctaccaaacctttcacgtagacaacagatattagctgggtatagagtcttttggacatggaaactgtataaagaagtggattgcaaatggctacataatggtcataagccatgacagccaacatgagactttccacatctgcaaaggtcccccagaaatacatctgcatagcacacaagtcaaatggaatcctgttatgctcagataggaaatcagccagcgtcttgggagagacagcagaggagtagcagacatcacaggaggaaagattgctcaggaaataatacatgggtgtgtgcagtcttgggtccaccttcatcagcaggatcatcccaacactggcgaccacagttaccccataaaccagcaggaagagcacgaagagcccctgctgcatgtgccttctatctgagagtcctaggaatgtgaagttagtagtcacactgcagttctcggcactcatcactcaaatctgttgggaaattcctggttgtgaaagaagaaatggaaatggagggtaaatatgtcaatttactatcattatagttaaacccctggtccttttgtagatgtaagtaatcaagaaaagagacagaccttcctaggactgcatgaggccaacagactctgagaaatattctccaattttgtttaaatgaaaaaaaaaaaattgacaacaatacatttgcaaagcactgtatagttttgcagtgccctttcatccaaactaaatcagactgttttcaatccaacttgtgtagtatttatgaccatgtttgtggctttcctgatggctgagatggtaaagaattaacctgcaatgcaggatacctgggtttgatccctgggtcaggaaaataccttggagaagggaatggctatccactccagtattcttgcctggagaattccatgaacagaagatcctggtgggctctacagtccatggggtcgcagagtcaggcacaactgagtgactaacactttgctgctgctgctgctaagtcgcttcagtcatgtctgactctgtgcgaccccatagatggcagcccaccaggctcccccgtccctgggattctccaggcaagaacactggagtggattgccagttccttctccaatgcatgaaagtgaaaagcgaaagtgaagttgctcagttgtgtccgactcttaatgaccccatggactgcagcccaccaggctcctccatccatgggattttccaggcaagagtaccagagtggggtgccattgccttctctgaacactttgctacttctgtctaatactaacaaaatgatatgctctgagtgaagcaaggctctgataattggggggttcacataacttgtcttttgacaagattgctggtttttttggtttgttttgtttttcagtgatgtagaaatgttgttatatcctgtgttagagaagagtattaagtaagaagcacaggtgatgaatatattgctttcttattccccctgtggagagggcagaactatagccagttctgaatataagaagtcctcacttccccattaacctctcaagtccctccaacctcatcataggagggatagatggttcatgtctcagaacccgctgggacagagagggtggtgatttttggataagagggtggaagggtctctatgaactaaatgctgagatgcacacagagtaacatgccagcgctgaccattcttctgcttggaagttgcagttatactggggagatgatgaagagcatttgagatccagttgcagagatgctggtagcaagggtcatagaggcaaggaagaaggcttggtttgctgcgtgagtcctttctgccctaacctactttcttccacactttgtattctgccataacagttttgtaagacacataacataaatgctctcatagtcacacttctgtaacctcagagacattcacgtctgagctgtggccccactccaattctctaaacattttaatattgtttgattgttttatttgagccagatttctcttcagtatctctgagttctgcctttctttggtttaagaattacttgtctttggaaggacaatggaattctatgtccaactgttatattttaccgaaaccaattatgtgacatataatgtcatcagttagtcagttgagtcactcaattgggtctgactctttgtgacctcatggactgcagcacaccaggcttccctgtccatcaccaactcccagaccttgctcaaactcatgtccattgagtcagagatgacatccaaccatctcatcctctgtcattcccttctcctccacttgtcctcttaaaaaacaggaattgaatgtagatgagagatagagaagagcactggaacagtggtctagtgatcactgtgcaggttttcaaccctaggacttaactcgtgtatctgcttagaaagacataattaagcaaaaatactttcctttaaaacttaaagcatttatagaaatataatatgtatgttacacataatgcatagtataacagataaatttttaaaatagtaaaacatctgaccatttccataatgtatgtttgctccttttatattccctatttatatgtatttaaaataaacaacttgtacaactaactaaaataaaaatgtgtgtactatttcatatgttcctttgtttatataaaataccttctttcaaaaaagcattaaaaaataaggaaatctcaaatataaatgaaagaaacagcaaagatatcagtgcctgtcccagaactcctgacttgtttgttgcacgcagttctgtctgcaggagggttcagcattgcctactgcctgacccagattatataatcatatctgtgtctggtccctgggtggtgaacccttagtctctcaggaataagtaacagatatgatgtaatttatcatctgatatttcatacaagtaagctgattgcacatagaatatagacctttagaatagtttgcctttggcccccttaatgcccaatattatacttattcagaaacagtgaatgcctctgatctgcaagcattcctaattcccagttcaccaatccttatgtagccactttgttttcattcaacacattagcaaacaaatgcatacccattccccctcacacacttacacagacacacaaacactctccattaaacacagtcatgaaacaaagattttgtaaaatcagcaaaaatctcaacatatttacattccgaagggataactggatgttttctacactatttggcttttagtttttaaataaaaatgatgttaggattatgtgtatgtacagggaagcctgacttgtatggacacagtgactgaccaacagtgactgaccaacagcaaggctttttatattatgtcataattacagtctgttagaaataattttaataattatttaattgacagtggtcacttccattatatggcaagattcattagtagaaaagcagatggagtcacgatgaaataagcccacatagagtgcaacagcaacttagaaaacacaaactttcggaaaatttaaaaaattaacacatataaagactgaagaaacacaaatttgacaaataaagagtctgaaaattttccacaaataaggagtattaaacagaagtttaagatataaaatgaaacctgtggcatttaggaaatcatacatattgctaggaagatagtacaaatacaaacagaatcatacaacattagtcaaaccaattttgattttcatatattattgtgtaacattgggaggaaaatgtatacgagcaaattttcaatggaaccattttatatttttacatttcatcagagcctctttcacatctttgttccgtaggctgtaaatcagagaatttaacatgggaaatcacaagggtatagaacaaggaggtcattttgtcttcgtctagagagtaggaagtacttggcctgaaatacatgaagagcagagttccccggaaaattgccaaagcagttaggtgggaggtgcaggtggagaaagccttgaacctcccctcagcagagtggatctttaccactggtaggctgatataacagtaaaacacaaaatgacctgagagggtgatcagttcaatgaagccaaaaatgataaatatcactaattcattgacctgtgtatctgagcaagatagcaagaggagaggaggaacatcacagaaaaaatggctaatttcatttgacccacagaaacataagcggaaagttaatattgtatttatcgaagcatccataattcccaccatatacaccccagccatcagcagggagcacaccttgccagacatcttgactgtatgaagcaaggggttgctaatagccatgtaccaattgtaggccatgatcgccaacagtagacactcagaatctgcaaaggtacagaagatcaggaattgtagagcacagccatagaaggggattgatttgttcttaatgaggaagcctgccagcatcctgggtcatggctgtggaatagcagaggtcactgaaggagaagtggctgaggaaaagtacgtggatgtgtgcagctgggggtctgttctaactaaaatgatcatcccgagatttgcaacaagaataatgagataaacaactagaacgtggtaaatagagtcactttgattatagggctactactaattcccaagagaaggaattctttcaaggaagtgcaattttccccatccattcttctttattcttcttgtaaaaatgctccagaaatgactgaaacaatgacatgtcaatgtttttactctttttgagacaaaatattatctgtaaatcagataaaattaattccagtacattttattctgagaaaatagcccatacaaatttccccacgatttgattttaaaaggttaagtgtgggataggagttttgagaaagtctgactctaaatttggatgtcacctatgatgtatgtgactagttggaaccttcacttgctttatttcagcaatcagttctttactgaaacctcattgcatgtcaaacataatatgaaagtaacactttaattaaagacgaggttggagtattcaaccttatattttaaagatacctatccaactaggaatacaagtgattacacttcttgagtacttaagaatcataatgtgtttatttgttcttttgcttgttcaattgctaagacgtgtctggctctttcaactcaatgttgaagcctaccaggctcctctgtccatgggatttaccaggcaaggacacaggagtgggttgccatttccttctccagggcgtcttcccgaatcagggcgtcttccccatctgctgaactgcaggcgaattccttaccactgagccacctggggagcccagtttgctcattattgtgtattaaataatgacagaatgaacttatctctgattttgaaagaatgaacaatatggtattattgtctctgctctactttttagtgtagatattgagcattcaatatattttagtaaaattatctctagaaatattttactgctttgacacattattattactcacgtgcaggagcagtctgctatcaaaggacatatcttttgaccagataaagaaaaattctagaaacaagaaactttagctaatgcattttcatcccttttgatcttaaccctgcttgttcattaaaaatagatgggacaaaagtggcaaacatatatttgatataagcttctatttgtgtgtatgtttatatgtatgtgcacgtgagtgcttgtgtgtgcatgcactctgttgatatgacatttggagtatgaatgatgaactgattttgctttagatttgagtaaatatgatatgtggttcttatggattgaatttgcacaaattattaatagtattagtattgtaataagtcattatgcacagcagcaaagaatttggctgcaatgcaggagacacaggttcaatctggggctcaggaagatcccccggagaaggaaatagcaacccactctagtattcttgtcgaaaaaatcctatggacagaggagactgttgggctacagtctttgcagtcacaaagagtcagacatgactgagtaattgagcacacacaacatgaacaatatgacactttttactgttaaaatattcaaaaaaatcttatatctttgttataccttttcacagtgcttaaaaaaaaatccaacttttccccttaattttaagatatacatatgtaaaattgtttcctaatcaaaataaatctgatttgtcctgctttaataagaaatacaatgggggacagatgtatacccatggctgattcatgtcagtgtatggcaaaaccaccacaatattgtaaagtaattagcctccaattaaagttaataaattaattttaaaaataaatacaatgttttttttccattagattacagataattaaccaaagaaaataaataaataaagtgttcatttacaagtctctaagtatttgattccttagtttttgaaatcttattcttcattcttcaaatgtggcaactcagaaacctacctgcgatgagcaagttctcctgagcttgcctctggcaggtgaacaatatagacagatcacacttaatttttacttagtgacagttgggagttaaatctctaaggcacttgccctcacttttctgtgttatgcaagcatgagattaattagatttctagttttgtattttcccccatgaatgctgtaactttagaaaatgccaaactttaattcttcacacttgaagaaaattgatcgtatcaggacggttaaatgattttttagtatgatttattgtgaccccaagtctacatcatcttcctcctgtcaaataagacatataatgaaactcaaatggactctctacttattttatctgttattatttcttttgctaaatttatgaaattaatagatttattaaatatagtgattatttattaatttgtttacccttaattattttcaatgtttctttactgctgaaacaatttccttcaccttcctactttggaatataacagtttttcaatggtatgttactaaccaataccttcttatcctcataaactgtctgtgatttcatttctgaagtcacatgttatccaacaagatttcaattatttgtataatttcacacatataaaatcatttattttttttctctaaatggattctgcaggaagaaaaaaagtgaatttctagatccagttctaaactaatttgattcatcagaacaccattgaaatcctcagttacttagtttctttgatgatcttacaccagaggtttatattcagtttataattatggtggtattaaagagttatcatgtttcatcttatagtttgcactgtttagcaaatcaaaaccaaaatatttttataaataaagatattgatgaagtgatgtgcatttaagttcccttaacaatcattttgttaacctctacatcaaagggtaatacaaaaatagatgttcagagacatatatggtactcaagtggtaaactaatagctgaaggtagggcaggtttctgtatatgacttttattctgcaactctgttgaatttattgatgggtcctaatagttttcttttttgccgatgtctttaggattttctacacactgtatcaagaatcttcaagtaatggtgtgtgtgtgtgtgtttgtgctcagttgtgtccgactctttgcaaacccatggactgtagcccgccaggttcctctgtccatgggattctccaggcaagaatactggaatgggctgccatttccttctccaggtcaggtaatgaccagttcagttcagtcgttcagtcgtgtccgactcttggcgaccccatgaatcgcagcacaccaggcctccctgtccatcaccaactcccggagttcacccaaactcatgtccatcaagttggtgataaccatccagccatctcatcctctgtcatccccttctcctcctgcctccaatccctcccagcatcagggtcttttccaatgagtcaactcttcacatgaggtagccaaaggattggagtttcagctttagcatcattccttccaaagaacacccaggactgatctcctttagaatagactggttggatctccttgcagtccaagggactctcaagagtcttctccaacaccacagttcaaaatcatcaattcttcagcactcagctttcttcacagtccaactctcacatccatacatggccactggaaaaaccatagccttgactagacgaacctttgttggcaaagtaatgtctctgcttttgaatatgctatctaggttggtcataacttgccttccaaagagtaagcatcttttaatttcatggctgcaatcaccatctgcagtgattttggagccccaaaaaaatagtctgacactgtttccactgtttccccatctatttcccatgaagtgatgggaccagatgccatgatcttcattttctgaatgttgagctttaagccaactttttcactctccacttttactttcatcaagaagctttttagttcctcttcactttctgccataagggtggtgtcatctgcatatctgaggttaccgatattgctcccggcaatcttgattccagcttgtgcttcttccagcccagcatttctcatgatgtactctgcatataagttaaataagcagggtacaatatacaaccttgacgtactccttttcctatttggaaccagtctgttgttccatgtccagttacccatttaaaaaaaatgcagaatgaaatagtagtttaatgggtccagcttgatggcattaggattcctgaaacacatgctaactatcttatgattgccactttcatccaaggtctaactgacctagagatatcacatattctattgttatgaatatgcttaaagagaaaaaaaaacaggcacaccaatataattggctattgccttgataggttcatactaatgtagctacagaatgtggtagcaggaatagacaagaaagattattctgtctaaccccatcttttagcagagtagacactatgtccccaagagaaaaagtgatttgttggaggtcacattgctagtgagctgaaatacaaattcagacccaattccattattgtttcttcagttcacagaatgctgaagaagatgacttcaaactaggttaagtttgctgcctcttaagatcaagccacacacattgatgtagtgagtactaatacacacagcagaattatcacacatacacaggcacagatatacacactatattttcatactttaaaaacgtcatccaaatagtctttagaaaattacattatacttgaccggacagaacattgagtgtttactgcttgataattttcttaaaattaaacacaaacagaaccaacaaatcctattaaagcagtctttaaagaaaagagtttaaaaaaaacaagggtaaagaggttaagggatgtctctttatcttaaacatatatgtgaaagatagtcattgaatctaattttatgcaacacaaaaggtttaattttataaacataaatatgttaagtatgtttttattaaagtaaattgagtgtggaaggagttggactgtaattaatttcctgatatgtgaaatattctatgaacagaaaatatattatctggaatataaaataaaatattttagagtaatatatacttttgtgttaaaactcaattcaatcagtaattgaaagcaaataacctgctgataattatgttttaatgtgttgctttattcttatgatattttaaagtacataatattcagcactctttatgcctaacgagatatatagaattagaaaagaaattaaattgaaaaccttgtataactcattatcccatcctcctggaatcagaaaagagtgactccatgttcatttttgatgatgtaaaataaaatgagtggtcatgacaacctgatataatgttatgtttttcataaatggattactgctaatttattactgtgagaacaaccttagtacttaatttagtgttacaaagtgaggattacttaatatccatctacttggcaatcaccactacttaaactgttaagaatacagttcctgtttatttcacaaatacacagagagtgaatataagtactcacaaatggaatactaatgcaaatactactttttcccccactgaacacaaattttttaataaccattcctttacaactgcaactgtattaaccaggtttttttttttctttcccctaattttaagaagaataatgctatgagcacacgaaaatggggcaaaaatggaaacagtggtagagtttattttcttgggctccaaaatcagtgtggacaatgaataaagtatgaaactaaaatatgcttgcttcttggaagaaaagctatgacaaacccacaaagtgaaagtaaagtgaagtcactcagtcgtgtctgtctctgtgtgaccccatggactgcagcccaccaggctccccccatccctgggattttccaggcaagagtactagagtgggttgccatttccttcttcagggatcaaacccaggaatcaaacccaggtctccctcatactagacagacggtctagacagtatgttaaaaagcagagacttcactttgtcgacaaaggtctgtacagtcaaggctgtagtttttccagaagccacgtatggatgtgacagttggactataaagaaagttgagtaccaaattgatgctttagaaatgtggtgctgaagaagagtcttctcttgtgttgttggaagagggtgttttgctataaccagtgcattttcttggcaaaactctattagtctttgccctgcttcattccgtattccaaggccaaatttgccttttactccaggtgtttcttgacttcctacttttgcattccagtcccctttaatgaaaaggacatcttttttgggtgttagttctaaaaggtcctgtaggtcttcatggaaccgttcaacttcagcttcttcagcattactggttggggcatagacttggattactgtgatattgaatggtttgccttggaaacgaacagagatcattctgtcgtttttgagattccatccaagtactgcatttcgaactcttttgttgaccacgatggccactccatttcttctgagggattcctgcccacagtagtagatataatgttcatctgagttaaattcacccattccagtccatcttagttcgctgattcctagaatgttgacgttcactcttgccatctcttgtttgaccacttccaatttgccttgattcacggacctgacattgtaggttcctatgcaaaatctacaactgggtattgtttttgctttggctccatcccttcattctttatggagttatttcttcactgatgtccagtagcatattgggcacctactgacctggggagttcctctttcagtatcctatcattttgccttttcatactgttcatggggttcccaaggcaagaatactgaagtggttttccattcccttctccagtggaccacattctgtcaaacctctccaccatgacccgcctgtcttgggtggctccacagggcatggcttagtttcactgagttagacaaggctgtggtccatgtgattagattgactagttttctgtgagtatggtttcagtgtgtcttccctctgatgccctctcacaacacctaccatcttacttgggtttctcttaccttgaacatggattagctcctctcggctgctcctgcgccatcgcagcctggcactctcggctgccacccggaccttggacgtggggtagctcctctccgccacgcttctgctgggtcagttgcagccggcattttacttcacggtccgtcacagccggcgcgcttctcaatgcaactgctagatattgctaattcagtcagaccacacagatatcttatattcgggggaaaggctccaccagaaagcaaatgttcaccaaaaatccctataaggcaagaagcaaaatggatctgaacttgaaacccagatctggggcaagggctgtagggagcatgacactggtctgagctggggggcagttcccaagcattatgactggtacttaaccaccttcctggctcagggtttacaagtcaatagttggaaaggacctggaagattatgtcatccaatccctgcctttgacagataaggaaatggaggtgcagggaggttaaatgcctttccccaagtcccgcatccagaattagcaggggcaggaccaaaactcaagactttcaacaatttcccaccttgtcacctctgctttagagcaaatcgaccatggtgttgcctgttggttaaattgccatctctctcaaaatagacctgtctctgtctgcacaaaggtccatctagtcaaagctatggcttctccagtagtcatgtacggatgtgagagttggaccgtaaagaaagctgagtactgaagaattgatgctttcgaactgtggtgttggactcttgagagtcccttggactgcaaggagatcaaaccagtccatcctaaaggagatcagtcctgaatattcattggaaggaatgatgctgaagctgaagctccaatactttggccacctgatgcaaagagctgactcattggaaaagacgctgggaaaggattgaaggcaggaggagaaggggatgacagaagatgagatggttgggtggcatcaccgactctatggacatgagtttgagcaagttctgggagttggtgatggacagagaagcctggcgtgctgcagtccgtgggctctcaaagagttggtcacgactgagtgactgcaccgcactgcactgtctgtatctggctctctttctcagctgggagagtgacatcagctctcccgagaagcccaactgcctctctgcttagctgtgccatcagctttagagtacctaagccatgacgacatggctcagccattctgagatccaaaactcaccaggtggataggtttcctgtggcagaagtcagaatactgccaagtgggtggcttagaagagcagatggaaatgtattctctgaaggttgaaaatctgaaatcaaggtgtgggcagagccatgctccctctgaaggttttatggagagacccctccttgcctcttctggcttctaggtgtctccagccatctttgatttcccctggcttgttgcaaaccctctacagcatcttccttcatcttcacatggcctcccttctgcatcttcttctcctcttaaaataacattagccactttggatttagagctcttcctaatccaatatgacctgatcgtaatgtaagtaattacatctacaaagaatctatttccaagtaagtttgagttccgagaccctgagtggaccagtttggagaggtcaccattcaaccactgggtgaatagtacactgggcttcccttgtggctcagctggtaaagaatccacctgcaatgcaggagacctgggttcaatccctgggttgggaagatcccctggagaagggaaaggctacctactccagtattctggcctggagaattccatggattgtatagtccatggggtcgcaaagagtcagacatgattgagactttcagtttcaattttcctgtggctggctcagccaactgcactgagtgtagagcatacgctactgtattgagtatgggcaatcccctccatcctcctccccctcacccctcccctacaccaggactgtgtaacccaggacccaaacattgagcagttaatgctggaaataacttctgagaccatctgacctgtggctgttaatctctgttgcataagagaatcttcccaggagagttttgaaaacaccaatgtccaagctcaaacccagagattctgattcagttgatctgaggcatgctttgggcatttataataatcaaggctactcagttgattctaatatgctgtcaaggttgaaacccaccaatcaagcccaccacttagttttcagatgagagacttgaggcagacaaaccttagccactcccctctgcttcccaatcccatccattcattgctactgtccagcttctgattctctgactggaacgtctcactctatccagattgtacaaggcccccagagttgacagaacaatatcaccatggtggccagcatgcccactcatgagagtgtgtgtgtgcatgctaagtctcttcagtcatgtcggactctgagaccccatggactatagtccaccaggctcctctgtccatgggattccctagataagaatactggagtgggttgccatgccctcctccaagggatcttcccaaaccaggaatcaaactcaagtctcttatgtctcctgcactggcagccgggttctttaccactagtgccacctggaagagaatccagtaaagcccctcaaggaccatgaggcaagatggcagccaccttgctgtggtcaccatatccacctcaatttccaatgcacacccatgacctatggaaccacaaactggcccaggctttgtaaagtgctacccaaatgcacttggtcactctattatatcattcgtggtagcatcacctcaggaacctggtaaaagtgtgcactttgcccactcacccatttgcttcctattacacatgttcttaggcatctttctggtgctgttctattttgtcattatcactgcacagtttataaaagcaagacacatttttcttacttctttttaatttttgtatattctggtatcacacccaatacaacaaattctttttcccttgctttagccagaaaaaaaaagccaaaatacacaccaaaatggccagctcaacacctgaaccaccaccaaataaccctaagattttctttcaaacagcactctcttttgggaccagagctgcaaacaaaagttgaacaattatgatggaggcaaaacaggttctactgctctgtctctcctagaattctaggcatctccctaatccatttctccttcctcttgtctccaatcttgagggagcccaagatcagcaggaaaaggaaccccacaaacagcctctacacctttgccttgtcaaagatttaaaaatcaggaagcaaataaccttagtagaataacctgtgtgctccttttgcttcttttaagtgtagtccacactgttgggaaattatgtgcaagtgtttcagagactccaatgtacctttcaaatactttggcatatggtatgaccagaaacagggctttccaggtggcactagttgtaaagaacctgcctgccaaggcaggagtcataagagatgcaggtttgatcccagggttgggaagatcccctggaggaaagcatggcaaccacttcagtattcttgcctggagaattccacagacagaggagcctggcgagttgcagtcttagggtcgcagagctggacacaactgaagcaacttagcacacacgcacatgaccagaaacagccagatgggacaacactgcccagggctcagcagcaggtctaggctctgggcctccccccaggtcacaaacctcaatcctgggcattttgtgtttgtgaaagtcactcagtcatgtctgactctttgtgaccccatggattgtagcctgcctggctcctctgtccattgaattctccgggccagaatattaaagtgggtagtcatcattcccttcttcaggggatctttccaacccagggatcaaactcaagtctcccacattgcaggcagattctttactgtttgagttaccagggaagccctagttgcagctaaactcagtttttgtgtcagttctgtgggtttccagaaagaattcagaactataacgtgaacaaacatcctctaactgatccaccttaagtagccagggttttgtgaattacatgttcttaggacaatgcacaccttggttctcttaactgtaaaagaaagattgtttttttttcccaaagcctaatagtgagcccctggaggtggggaaggagacctgggtggaatgttgccaagagtgtgtttctggtcaattatctggtcagggaaggaaggaacctggacctcactgtacaggttgtgtgtgtgtgcacatatgtgggtacatgagtgaatgagtgtgtgtgactgtattgcatgagtaagtatgcttgtgtgtgtctatggggacgtgtgtgaatgtttgtgtgtttgttttgcaggaagggggatccctttcagggcatgagagtgggctctcatttgcatttctgagtctaacactcagaaatgaattgtccaaggagaacacatgtgctgactaagcaagagattttattgggaaggggtgctccagtggagagcagcagggtaagggaacccagaactgcgctgccacatggcttgcagtctcgggttttatggtgatgggattagtttctgggttgtctttggccaatcattctgactcagagtccttcctggaggtgcacacattgctcagccaacatggataccagtgaaaaggattctagtaggtggtcagacatgtggcatttcctttgaccctgcctgaattcttccgatgggtggtggcttattagttctgtgttcctcaccaggacgtcctctcataaaatatctcaatcagatggttactgtggtacctggtcaagggggatggtttcagtcagtgtgtttctcctaacatttgaacaggtgtgaaagagttctgtgaccatgctgtgtgcatgaatgtatgtgagtgtgtatgtacatgtgtgtgtgtgtgtatgtgcatttgtgtctgtctgtgggggcttgggcatatactcaattcctggggatagtcctgtagttcacaggtaacctgttgagacctctggtctcagaaggttggttcctgggctaaacaggttgcacccctgtttgctggaccatgcccagaaagtacacctctgtggcactcatattctttttcagcctacacttggagattctgtgttcagaagtaaagctaattttttctgaatcgtccagcctcttgggcaactgaaagcaagaacagaatctccttagcccaagaacctccccaggatcagcctcaaaggagagctgctctcacgacttttatttgcatccctggtgacagggtagagtctgcctgcaatgcagaagacctgtgtttgaccctgggtggggaaggtcccctggagaaggaattgcaacccactctagtattcttgcctggagaattccatggacagaggagcctggtggcctatagtccatggggtcacagagttgaacatgactgagcaactaacacacacatatggtatgtttggaagaacaaatgcatttagtttcaaaaatgcacgcctggagaagactttaaggcaggtgaacaaccctgggatacttctcacctgccagcacaagaacagcttttgaggggcctgcgaagtgggtgtggggtccctgggaggggaaggctgccaggaaccaagagatttccaactacacttaaaaatggagctacccgcaagacctgtatgtcagccacctgggcaaggacaggcgatgtgcattttttcagacctctttaaggctctgttaaaatgtctttgcatgtcacaattctaatacagataatttctaatttaactaatgataaccagtcaatcctaaaggaagtcaaccctgaacattcattggaaggactaatgctgaagctgaagctccaatattttggccacctgatacaaagagccaactcattggaaaagaccctgatgctgggaaagattgagggcaggagaagagggaggcaaaggatgagtcagttggatggtgtcaccgactcaatagacatgagcttgagcaagctctgggagctggtgaaggacaggggagcctggtgtgctgcagtccatggggtcacagattcagacacgacttagtgactgaacaacaacagcaatactttctagttcaaagatgctcttgcaattttcctattattatttctttgaccacactgcatgtgggatgccagttccccaaccagggatggaatctgcatgccctgcagtaaaagcacagtgttaactactcgaccaccagggaagtcacactctcatcattttaaaggaagcccacttcagatcactttctcagtggagggtccccttctaaagtttctgtaagcattaactcctatcccatcttatctaacattattattattactttggctgtcctgtgtcattttgaggtgcatgggcttctccagttgtggcactctggctcagtagttgtgttgcatgggtctagttgcctggcagcttgtgggatcttagctccccaatcagggatcaaacccgtgtcccctgtattggaaggcagcctcttaaccactggaccaccagggaaatccgatcctacctttttattttaaaaaatagtgtaatgtagggttatccctaggataatgttggtcctggtcattttagtggtgtcctggggcaaatcacatcttgtgactgacttcccgtctttctccatcaggcaaggatcgggtgaagcaatacatacatacacatacacacacacacacacacacactgtctcagtggaggatgcaaagtaaaataaggaaaaattaaagatattggttccaaataaatattttcataatttgtttaatttctaaggcacaaagggttttcgtagatcgctttaacctctaaaaatacaaacttggcactagtaacatcaggtagtcaattcatttactaaatttattttttttttcatttactaaatttaaatgtaacatggtaaaactcatcttcagaatctgattcctaaacagatgtgaaacaggaatcaccaggactcatgccagagacaacttcctaaaataaatggctaacaaagcaagtggacggctgggagtttggctgcccctggttaaaccacagcatccagtacgagggaagagaaagtggccatcgtatgaaggctttgttcctcttactagacatctttttctaaatcccagaaacctcagaatgctgtctccaactccacaagcgagttttctggaaggtgtgtgccaatgtcaaaaggacacagcctggcggataacgctggaaccctgggagtctagatgagcatggaaggagtctcccattctgtcctccaagccttgagtaggaacccagcccccacacacggctgccgccatgaggctggctcaggggtgggggaggggaaggcatagatgaaccagaacactcttttgactcagtactttccacttcctccccatcttgcctatttaccacaactgcccaagatgagtcaccaagaatttaatctccctggattttccctgcccgaccttgaaatgatgctagagagcgcaaagatccagcaggatacaggccagcccaacacgacatcatggccgaagaggtgcagtgttacgccatctgaagaaccgagatgtgcttggtcaaagttgaaacagggggcaaggagattctgcaacacagatgatgttaagagtcctcccgcaggcctggtgtctgagagggagggagcaagagaaggcctctgaaagggagccagaaggagagacaaagagaggcaccctcctctgtgccttccctggaatcagggacagaggcatcatggagacaggaacaaggtaggcggcggtggggccctcccacagtttccggtccccgccaccctcccactgctgccggtccccgctggtcttcgtaggtcctcacgtctctgtggaccctgaggttctccatccctctgaaacttggccacaagcgttcactcgaggtctgtggtgccgaatctctgttttaggtcctctagggctgaccatcaaggtattaccaaggggggcagtcccttcaccagtccttgaaaataaactaacacaataccacagaggcaggaaattatatgtggtgtgaatgcatgtgtgtcaaagagtctgaagactcggaagatactcaccgatacactatcagtagttatctaagtgtagtgaaattctaggtgacttttgtctttctttttataccttctgactttgtttcaagtattaagataagcgagtatcactttgtaattataaaaattattttgttctaaaaaagttgaactaccattttagagcagaaaaataggttatgcatgattatgaaaactatcagagaaaaacacattttttaaaaaataaaggaggttaataataaataaggtttgaatccaaaccttatttgctttgaaacgtaaactgcacaacacatgccctaaatatcatggattacaaggtcccagaatgccaaagatataaatgaacataaaccagacaattggagtgtataacaacagatactggtattattcagatacacaagtgagctgacaaattacaaggctaggaatcatttcctgttgagtggatcatgctatggtatccccattgctaaagtatgggcattattttgcaaagaatggttactgggaggaaaacacaaaggagacactcttttcatagtctagctcacatagctgagaaatgagacagaaaacagcccaggttcacttcattcttttggcaacatctgaatatgcgtgttcaatctcctggtcggcaggacatgtgtttgtgaattcatcccgagcatatgcattgttcaagtacctccagatgccagtcatttcagaaggaaattcaaaatctctgtatctcttggccacgatctgaaaatgaaaaggaaacagtcaagaagggaaaacccacaaacataggcagtttcttcagacaatccattcttctgaggcgtgtactatattctttctcaagttcccatgtcattctacagcctttcaagctgcccaaattgcgatgagtttgcagggggcacactgagtgtgggactcaaaacacaggtgctacacaactgtgcccacccattcatcacagatggtcctcgtgacccgctggtatgaatttgctctattgtctagtcgctcagtcatgtccagctcttttgtgaccccatggactgtggcccaccaggctcctctgtccatgagatttccctggcaagaatactggagtgggccaccatttccttctttaggggatcttcctgacccagagattgaacccaaatctcctgcactagcaggcagattctttaccatctgagccaccagggaagccctgagcttgctctgtaatctggtggatttctctttgtgcttctagtagttttctctccctgtgttctgctgctgagttatttggtgcctaaagattcagatggctcagatgataaagagtctgcctgcaatacagaagacccaggctcaatccctgggtcaggaagatcccctggagaaggaaatggcaactctttccattattcttgcctagagaatcccataaacagagtagacaactcatgggatcgcatagattcggacatgactaagcaactaacaatttcactttcaagggttcgggatggattttcagtttagattgtgctaggatcactttgtagtgccctctctttttccaatttgctgagcctcacctcctgaaaccccaagcaaccatgtatgttacacctgtggatttccatcattctgcccaagagtatcatttcactgtgggtctaccgtgtgcagagggcagattcatgaactgaaaaatccttatcctcaaggaaacagtggatataaggatggggtagctgagaatgaatatcatgaaaacacagtggtgtgagatgtctcctctggctggagggtgtcactgggaattcatcacaaaggacagtgtatcctctttgcagatggtatgggttccctgcggttgccttaataaagcactacagtcatgggtggcttaaacaacagaaatgtcttctcccacagtctgggaggcccagagtccaagatcatggtgttagcagggccaggttccctctgaagcctccggcgaaggatctgttccaggtgtctccctgtctctggctcatgggagtacagctccagtcttcacctggcattttccctgtgttggcatctctggatccaaactcccttttataggaacatctgtcatgttggattaggggcccactccactgctcctaatcaattaacatgacctcatcttaactaattacatctgcaaaaactctatttctaaataaggtcagttttgagatattgggagttaggagttgggtctaacttagatacgaatttggggggacaaatatttggaaagctatgacaaacctagacagtttactaaaaaccagagacatccctttgccaacaaatgtgcatctagtcaaagctgtggtttttccagtagtcatgtatggatgtgagagttggaccgtaaagaaggctgagcaccaaagaattgatgcttttgaactatggtactggagaagactcttgagagtcccttggactgcaagatcaaaccagtcaatcctaaaggaaatgaaccccgaatattcattaggagaactgatactaaagttccaatactttgaccacgtgatgcaaagagccgactcaatggaaaagaccctgatgctgggaaagattgaaggcaggaggaaaaggggacgacagaggatgagatggttggatggcatcaccgactcaatggacataagtttgagcaagctctgggagttggtgctggacagggaagcctggcattctgtagtccatggggtcccaaagagtcagacactactgagcaactgaacaacaatacttggaaggactaatatttcccattgtattgcctcctgggatgtttggatgacaagagcatggaatttgtcaccagttagaagatcttaatgacttatttctcagattttggaagctgcgagctaatgatgcagcaagacaggaccacataactttccaaagaacctcctaaattaatatcttttacttgaattcaatcttactagatgcattggagaaggaaatggcaacccactccagtgttcttgcctggagaatcccagggacagaggagcctggtgggctgccgtctatggggtcgcacaaagtcagacacgactgaagcgacttagcagcagcagcagcaagagattactgtcaagactcctgcttttcttttatttgcatttgcctgcttttgctttacccaaacattctgggtaaatttattacatatgtgcctctcataaatgtaaacttgttttatatcctatcttactaatgttatactttgttttccaacttcctgtaaatatttttgcatttgtgtatgtgtgcacttccctctctggtggtttggaaggtttatggtctgttttaactcttccagtggtggtggttgtttagttgctaagtcatgtctgactctttgtggctgcatggacgataacctgccaggctcctctgttcatgggatttcctaggcaagaatactggagtgggtctggtggtttcctatataacttaaaaaaataggaattctttatttcctcactatcaactattctttgactgatctctacttactcctgacaataagcaaggaaattagtatacttacatttcttttcatttctgatctattatactccttccaatggtgtgaaaatagaagtttactatatttgattcagtcctgtatctgtaattcccattgctcttgagttttagttctggtttcagatctaaagaggttctatgtctatcactaatccttttataccacacaccttctctgttcctggattcttattttatccttttttattatgtcatcatatagaaattttatttttacaaaatggctcagggatgcttattccatcaagaccagaagtctaggtgaaagcaacaatttacttggatataaaattcttacatcacacatcctttcctttaatcctttaactattggctgtgctgggtctttgctgcggcacgcattttctctagttgtggtgcatgggcttagttgccccaaagcatatgtgctcttaattttccgaccaggcatagaacttgcatcccctgcactggaaggcagattcttaaccactaggccaccagggaagtccccaatcccttaactattaaaccactgttttctggcttttaatgtgatcctagaatcccacggagaagagaatggcaacccactccagtattcttttccttttttaattaatttatttttttaatcaaaggataaatgtttacagaattttgttgttttctgtcaaacctcaatatgaatcagccatcagttcagttcagttgctcagtcctgtccgactttttgcgactccatgaactgcagcacaccaggcctccctgtccatcaccaactcccagagtttacccaaactcatgtccattcagtgatgccatctaagcatcgcatcctctgttgtccccttctcctcctgccttcaatctttcccaacatcagggtcttttcaaatgagtcagctctttgcatcaggtggccaaaatattggagtttcagcttcaacatcagtccttccaatgaacactcaggactgatctcctttaggatggattggttggatctccttgcagtccaagggactctcaagagtcttctccaacaccacagttcaaaagcatcaattcttctgagctcagctttctttatagtccaactctcacatccataaatgaccaccgagaaaaccatagccttgactagatggacctttgttgacaaagtaatgtctctgctttttaatatgctgtctaggttggtcataactttgcttacaaggagtaagtgtcttttaatttattgccataggtatgcatatatcccctcccttttgaacctccctcccatctcctgccccatcccactcctctaggttgatacagagcccctgtttgagttttctgagacatacagcaaattcccattggctatctattttacatagggtaatataagtttccatgttaccctttccatacatctcaccttctcctccccctcccatgtctgtaagtctattctctatgtctgtttctccattgctgccctgtaaataaattcttcagtaccaggattccatatatatgcattagaatacaatatttatctttctatttctgacttacttcactctgtaaaataggttctaggttcatccacctcatgaggactgactcaaatgtattcatttatggctgagtaatattccattgtgtatatgtaccacaacttctttatccattcatctgtcgatggacatctaggttgttttcatgctctaggtattacaaatagtgctgcattgaacaatgggatacatgtgtcttttttgattttggtttcctgagggtatatgtataggagtgggattggaagaagcacaagctggaatcaagattgccaggagaaatatcaataacctcagatatgcagatgacaccacccttatagcagaaagtgaagaggaactaaaaagcctcttgatgaaggtgaaagtggagagtgaaaaagttggcttaaagctcaacattcagaaaacgaagatcatggcatctggtcccatcacttcatgggaaatagacggggaaacagtggaaacagtgtcagactttatttttgggctccaaaatcactgcagatggtgactgcagccatgaaatgaaaagacgcttactccttggaaggcaagttatgaccaacctagatagcatattcaaaagcagagacattactttgccaacaaaggttcgtctagtcaaggctatggtttttcctgtgatcatgtatggatgtgagagttggactgtgaagaaagctgagtgctgaagaactgatgattttgaactgtggtgctggagaagactcttgagagtcccttggactgcaaggagatccaaccagtctattctaaaggagatcagccctgggtgttctttggaaggaatgatgctaaagctgaaactccagtactttggccacctcatgcgaagagttgactcattggaaaagactctgatgctaggagggattgggggcagggggataaggggacgacagaggttgagatggctggatggcatccccgactcgatggacgtgagtctgagtgaactccgggagttggtgatggacagggaggcctggcgtcctgcaattcatggggtcacaaagagtgagacacgactgagtgactgaactgaactcatggtgcttttattcctagtttttttaaggaatctccataccatcttccacagtggctataccagttcatattcccaccaacagtacaagagtgttcccttctctccacaccctcttcagcatttattgtttatagactttttgatgatggccattctgacctgtgtggtgtgatacttcattgtagttttgatttgcatttctctgataatgagcaatattgagcatcttttcatgtgtttgttagccatctatatgccttctttggagaaatgtcagtttaggtcttttcccactttttgactggcttgtttgtttctctggtattgagttgtatgagctgcttatatattttggaaattaatcctttttcaattgtttcatttgctattagtttctcccattctgagggttgtcttttcaccttgcttatagctttctttgctgtgaaaagcttttaagtttaataagatctcacttgtttacttttgtttttatttctattactctaggaggtgagtcatagaggatcttcctttgatttatgtcagtgccactccagtattcttgcctggagaattccagaggagcctgacagggcgttgcacagagtcaaacacgactgagctgctaacactgtcacctcagtttagagacatatgaggctagtctgaatttctttgttgggtaggtgcacttaccttttattattactattatcatcatcatctgggcacccaaaggggttttttttttatcatcaaagttcaaatataatttaccagctatatcacagtgtgttgactgtccaggacaatatttttctaatcatggatggctatttaaagtcaatgttcaggtcatcctttaattcaaaacactttacctctgagtcttcttttgcctctttttttctttcctgttctttttcctggaggttcacctttacctcttgcttcttctccattcgatttgagatcatttcctcatgctgtcttccaaatccttgatggacttctgcaatgtcattttccacctcttgctactcctaatacaacttctaaacaatttctgaaattgttttgtctttaaggtttttttcagttccaccagtttcattttcatcctctttatgagattatattttttgacactttgttacttgtcttcgagcactttctccaaaggttcatgtgttatgctgagtagctcagtcatgtccaactcttttgagaccccatggagtgtagcccgccaggcttctctgtctatgggatttttcacctaagaatactggaatgagttgttatttcctactccagggcatcttcccaactcagggatcaaacccacatctcctgtgtcttctgcattgcacttgggttttttacccactaagccatagggaaggattcatattctctttcatttctttgaggctgtagagaagtatctgtctgaaaagttcaaatacttttcagttactgaaaccaatcttaaccagagaggtgtttctcatctgcctttttctcttttgttctatttaacccttccccctcttctctgtgatcatctctatccacatagaggtcccacttagattcctcttggttactaaccatcctttaatgggcagacccgttggacctactatttgcttaaaaacaaggtggagagcaatgggaggaaggccaggcaacaggcagaccaatttggatatttatcctcaaacacctgttcatcaaggggcttccctggtggctcaaatgataaagaaactgcctgcattgcagaagacccaggttcaactcctggtcaggaagatttcctggagaagaaaatgacagcccactccaacagtcttgcctggagaattccgtggacggaggagcctggtgggctagattccatgggtggcagaatcagacacaactgagcgactaacactctaacttttttcacctgctcttcaaacactgctctatactctgccccagggacacatgagggtttagtgcctcctccactctgaagctcatggattaggaggaggtcgccctggctaaaagtgatgctgaggtcatctacagtctctcttctgagtgattccaagcttatttcttttctctgctcagcagtcacaaagcagaatgcctctttccttctctcctcccctccatctcccctccctgttcctttggctcaggggacagtggcagaacacacagatgacacctctgaacagtttcaccttcagctctgcctccacagagatctcatctccgtagggctggtccctgcccctcttggcccactcggtgctctgtcctcaaacaaagaagcttaggttgggcacttcaaggctgtattatttacttttacagacatccgaactttactgaagatctagagaagctagtgcctaagtctttgagttggtggtccatccttttctaattttacaaaaggtggagggggatttccctggtggtccagtggctaacactctgagcttccaatgcaggaggtgcatattcaatcttagatggggaaccaaggtcccaggtgctacccaatgcagccaaaaagaaattaaaggtggagataatgctttagattttcagaatgcttttgctggtttcaggataggaatagattataaagtcctctattttctcattgtcttaccataaattcctgtagattgattctcattgcctttcagaagcgctccatcctggaagattattaagctgctgggtattttgagtgctaagtggctttgaagattttgcagttaggtcttccattggagccgtggactgctttattttactctgaagtttataccctctactgacattttaaacattctttttttataggagctaaccaagtggcaactgatctgtgtatgtatgcatgtgtgtacatacgtgtctttttcttgccttccctaaactccatgtgcttctgtgatgttacactagtcagagcaatgatgagaatatgtttaataaagggactaaaccagacacaatgacataaataatctattggaaaatggctcccaaatgtccagtttggataatcaccaatgtggcaggtttgaaggactgatttgccatcatgaaattttatgtcagaacactggcatttattaaaaagaaaattcacttggaggatcagcagcatcctcaagccttagctttcaggttggtgccccttgaacacatcagggaagacagaagaaagaagatgaatggagcaaggctgggaatggagtagggaaggaaaagaaaggcaaagaatgactggagtaacggggtggccagtcacccacaggacagccatgccacagactgtgggaacctaatttgtaaatttctaaatgccaaattagtcatgtatggatgtgagagttggactataaagctgagcactgaagaattgatgcttttgaactgtggtgttgaagaagactcttgagagtcccacggactgcaagaagattcaaccagtccatcctaaaggaaatcagtcctgaatattcattgaaaggactgatgctgaagctgaaactccaatactttggccacctgattcgaagagccaattccttggaaaagaccctgatgctgggaaagattgaaggcgggaggagaaggggacaacagaggatgagatggttggatggcatcactaatttgataaacatgagtttgagtaacctctgggagtttgtgatggacagggaagcctagcatcatgcagtccagttcagttcagttcagtcactccgtcatgtccaactctttgcgaccccatgaacctgcagtccatggggtcgcaaagagtcggacaccactgagcgactaaactgaactaaaatgtcaaataaacgcattattagaacacaaggtcgttgacttgtatttccctatgtcttctctccaatctccctatccttacaccaaggacctagttctggacctggtatgatctaaataataaggatgccccagaacaagggttgggcttcttcctggggcatctagggctactgaggaccaagggcatagcaacagtgataatgatacaacagctaacagcggtgagtaacagccagactcgggcactttggagagcagccataaatacggagaccaagggtggggtcatctgcttctgaatttcagagtcacccccagaagttctgcttttagtaagtcaggggctgaactgatgggtttacatttctaaaagggcttccctggtgcctcagtggtaaaaaatctgcctgcattgcaggagatgtgggttcaatccccaggtcaagaagactccctggaggagggcatggtaacccactccagtaaacttgctgggaaaatcccatggacagaagagtctggtgggctgcagtccatgaggtcagaaagagtcagacacaactggaggcctgagcaggcacatttctaaattagaaggcataattcttatgccaacaaatgttggagaaccactggtctagggaatctttaaaccctaattatacatgaccaatgacccttatttcatgttcagtcacctgggaaaacaggctgcatgtggtccagccgaggagctgtcagctgctcaccagctgttaaggggtctgtgttaagagccaacctcctcctttgtcccagggttaggcttactcttcccatcaccaacaattgactgagttcacattttttttttcaaggttggctcagttttttggttgttgtttttgcttttggactgcactgctcagcttgcaggatcttagttccccacccaaggattgaacccaggccacccgggtgaaagcgctgagtcccaaccactggaccaccaccagggaatttctagagttcacattttaatccttgtagattccacacaccatctccaagactggagtgtgaaataccagctataatcaatgtattccctcaaattgctttcacagagcttgtctttaggctgtgggggttaagactggaaaaaagaagctgtgaggatggagggatgagaaccaagctctcagatgcttcatgagagccgccaaggaacacctgataatagcatccacagatctcagacttggggcttggctgccgcaaacagaaacgagctagacttttaaattcaagagctggtgttttagattgtcttgggaaaaaacccacaagtcaaaacaaaatggaacaaagccccattcatgtattcagcacccgacgtaggaggaaggacaaaccttaataatgtggagcttgggtaagaggttgcagtcagccagcgtgagctcattgccatccaggaacttccgcccagaaatagcagcttcctcagtgctgtaggcatctatctcatcaggcaggggactgttcagataactatctagcttcttcagggcctttaacaggttcctttcataaactgaaataggaaggcagaaaacaactgatgagccatggaaatccatgtctcctctgtctttgtcattgttcagctgctcagtcatgtccagctctttgcgaccccgtggactgcagcacaccaggcttccctgtccttcgccaactcccagagcttgctcaaactcatgtccattgggttgatgatgccatccaatcatctcatcctctgttatccccttctcctcctgccctcctctctccagatatcaaaaaaaaggagtctgttccttccctcctgagacacagccagtgaatgttagagactcaggaaggagacaggtgggtttatgagatctaaataaaagactcacttctcctcggaaaataattctgctctttaaacaacactgttgcttctagaactcattcatttattcaaaaatctatatggaaaaactttcatggtgggcatcaccgactcaatgtacataagtttgggtaaactctgggagttggtgatggacagggaggcctggcgtgctgtggtccatgggattgcaaagagtcagacgtgactgagtgactgaactgaactgaatggttaagactctgctttccaggtgggatgggaggtgggagggaggctcaagagggaggagatgggtgtatacccatggctgattcatgttgatgtatggcaaaaaccaacataatatgctaaaggaattatattccaactaaaaataaataaactaaaaaagactctgcatttccaatgcagagacaaggaactaagatcccacacaccacaccatgtgaccaaaacattttttaaaaattaaaaattaaaaaaaaatctttatggaaatcatataatgaaggaagcatcaatagaagtttcattcaccctgaattccatgggagagcaagaaattactggtggtgatgatcttctcctaaaaatgtccttttctggacaatctctagaaaagcactcagtccctgaaacccacgtgcaggctcagagtaggaggtacttttcccttatttctatacacaggtccctcccccctgtgcagtgagtcagaattccccgaatcttataagaagccacaccagaggcggaatagaggtccatgcagaaaacagaaaacaggaagatgggagggactcactctcatttgcatccttcttggtgttttttataaatgctgagaacttggcaaacacgtcatttccagcagagttagattcagggtgttgggttcccagcttagggtaccttgaaaagttcaaagtgagagtatcacagatcagcaatgtttgagttaggagaatagaaagcaggaggggaagaaatgcctttctttgagcagatataaaaatgaaaactgctccttaagtgttttcctaatctatccatcttcaaagttgggagcaacaccagccaggagtaaagcactggatggactgttctcatcctgggatggagggccccctggccttgctggtctcggttctctccctcctaaaataaagatgatgaactagaaggctcccttgcaagcccagcctgctgcgatgttgcatgtaacacacattcccaacgggccatcaaaacgggccaccccacgtgacatcagcccacttcctgccatcaaaccctaattgccaaatggcagagtagagaattcccagccacctagactcagggcttctaatctcgctgtgtttcctgtggcacatcgcaggtacagctcaggaggtaagcgccatggccacagaaaaccaacacacagcaccaagagctttagaagtgtctgtggacagggaaggttttgatgaggcccaccttgggggagccaatttctcctctaagaactcctcgatcttattcacatctgtcttgacttcgccatcaaaagtcatgaaaggtggattggtgccgggagccaagttctgcaggtccgcaggtttcctgggcaggggggaagggcagtgccagggttgggatcattgccaaggcttaaccaggccccccgacacacacacatacacacaacagtggaagagaaaccacccttgagaatttcaaaggcaactgggagtttacaaactgtcccactggcaaggaaagtgtggccctttatctggagacgaggctgaaaagttaaccctccccagtgttatcagccaggagcggggctcaggcaggctccagagagagtcacggctgaccagtcacggggtgggcaggctcctcccggttcccctcctcctactcctttcaggttacatctgaccccatcctgtaataactctgtggcccacgtactcccgctccaatccagggtcttgacccagggtggatatgcccgggacagggcccacgggtcctaggagtgtgcatgcgtgtacccatgtgtttctgtctctgtgtgttccgtctgtgtgtgtatgtgtgtgtgtgtgtctgtgtatgcgcctgtgtctgtatgtctccatctgtgcatgtgcacctgtgtgtctgtgtgcctctgtgcctgtctgtctctgtgtgtgtatgtgtgtctgtgtgttgtgtctgtgtatgtgcctatgtctgtatgtctccatctgtgtgtgtgtgtgcacgcctgtgtgtatgtgtttctgtgtgcctctgtgcgtgtctttgtctcagtgtttgtgtgtgtgtgtctgtgtgtttgtgtctgtatttgggtctgtgtatgtgcctgtgtctgtatgtctgtgtgtatgtgtgtctccatctctgtgtgtgtgcctgtgcctgtgtgtctgtatgtgtctgcctgggtgtctctctgtgtgcctgtgtgtatagggaattggggatagttatttcaatactgtagaaacctggtcttaccttttcaagtccactgttgtcacattaaatataacaccctttagccagagaatcataaagagacgctgagaaaatgggcaatttccaatactctcaccatcacagccagcctgcaaatggaagaggagatcttcatcagaactagtctcacaattacaagtgccagactccactctgcacgcacacaaaatcatggtgaatgtttgttaacagtgatgatactgtaagtagccttctgaggtcccttcccccagcctacaagtgggagatgtgggcggggaggacacacgcactcgctgagccttctgccttccttccatctcctcaccacttacttcctgccattcggggcctctgaatagcagttctcagagggaaaagagcagccagagggaaccccctttattactaaaggcaaaaaagaaagacatactcttcccctccctccatctcttgatcctctttagagacacacctctcttgccaggatgatcatttgtgaaaaagaccagcaggctctctcaccaggacacgatgcccagcattctctactgtttccatctctggaatgaggactagttcctatgagttctagaaccccaggacactaaaatgtttaggtcccctcctccactggggagcatttgtacttagatggcagattgttcacagttgatatggagggtaggaaagtaggtagaaacaatgtctccctgataacctgagcgggtcacatccacacacaggtacccggacgcaggcacagaacactgagcagacatcctcccttctggggcttacgggagaaaagaaaggcagatgttagagaagagaggggagccatagacttcatcctcctggggcagttcccaatctcttctttctcttcccaacaaagttatagcactaacaaaatgctgccggaaagaccagaagactcagccaggctctgatgacagaaacggccatatttaggccaggaagtccatttattccacctgcagtccaaacggaattgagaggaaagcactgaatctataacctgaataacagaaagggagaaagtcaactgctggtttgagaattgcagaaaggaaaaaagatgcttcaagaaaatcgggcatcttaagaaattcttcagaggtggttctctggcatgaagttcttaagtcacctggagaggctgttcataacaagctgttcctacaaatgatgagttgataagagaccccaaactcagtattaaaaaacagtcgatccacctcttcacaaagacaaagcccagatggccaacaagcacgtgataaggttcttaacatcattagctaacagggcaacgcaagttataaccgtaaatagattcgacgacacacctaccagaatggctaaaatgaaaagctcagacaatatgaagtgtggacaggaaggtagagcagcggactccccatccactgttggtgagagtgcaaattggtgcaaccactctggaaaactgtttggcagttatttacccaaaataaacatgcatttatgctatggcaattatttacccaaaataaacatgcatttatgctatgacatagtaattacactcccaacagaaatgagtgttaggggcacaaaaagcacttaaatgaatattcctaacagctttagcgtcatagccaaaacctggaaacaactgagacaccgccaagagtagaatgaataaataaatggtagtgagagagtcatttcctaggcaggttgataagaagtctaggggtccccaagggtctggaattctcaaggagtaagaaaggacaaactttcttttttcctccacattccttacgattatgtatcctgcctgaggacagtctctggattaatcgttctggctaatcctgttatcttaaaatgtaaattatgggagtaggtctggtctttacaaggattatataacaataatgtatcctgcctgaaggcagtcactggattaaaccttctggctaactctgttatcttaaaatgtaaattatgggagtaggtctggtgagatctttacaacctccagacattctttggattcactggagagtatataactccattgctaacattagcaagtgggtactctttctacccttttctgatgtctatgtcacaaggtttctctaactactttatactttaataaaattttattacacaaaaggaccccatagcccaggggcggcagccaagaggagctaccccatgtccgaggtcggggcagtggccgagagtgccaagctgcaacggcaggaacggccgagaggagctaccccacgcgagaggtcaggggcagcagctgagaagggcaatcccacgtccaaggagcagtggctgtgcgggcgccatgagggcctagaggaggtactccacgttcaagggcaggtgggctggtggtgaggagataccgctcatccaaggtaaggagcagcagctgcgctttgctgcagcagccttgaagagataccccacgcccaaggtaagagaaacccaaataagacggtaggtgctgcaagagggcatcagagggaagacacactgaaaccataatcacagaaaactagtcaatctagtcacactaggaccacaaccttgtctaactcagtgaaactaagccatgccctgtggggccacccaagacaggcgggtcatggtggagaggtctgacagaatgtggtccactggagaagggaatggcaaaccacttcagtattcttgccttgagaaccccatgagcagtatgaaaaggcaaaatgataggatactgaaagaggaactccccaggtcagtaggtgcccaatatgctactggacatcagtggagaaataactccagaaagaatgaagggatggagccaaagcaaaaacaatacccagttgtggatgtgattggtgatagaagcaaggtccgatgctgtaaagagcaatattgcataggaacctggaatgtcaggtccatggatcaaggcaaattggaagtggtcaaacaggagatggcaagagtgaatgtcgatattctaggaatcagcgaactaaaatggactggaatgggtgaatttaactcagatgaacattatatctactactgtgggcaggaatcccttagaagaaatggagtagccatcatggtcaacaaaagagtccgaaatgcagtacttggatgcaatctcaaaacaacagaatgatctctgttcatttccaaggcaaaccattcagtatcacagtaatccacgtttatgccccaacgagtaacgctgaagaagctgaagtcaaacggttctatgaagacctacaagaccttttagaactaacacccaaaaaagatgtctttttcattataggggactggaatgcaaaagtaggaagtcaagaaacacctggagtaacaggcaactttggccttggaatatggaatgaagcagggcaaagactaatagagttttgccaagagaatgcactggtcataacaaacaccctcttacaacaacacaagagaagactctacacatggacatcaccagatggtcaacaccgaaatcagattgatgatattctttgcagccaaagatggagaagctctatacagtcagcaaaaacaagaccaggagctgactgtggctcagatcatgaactccttattgccaaattcagacttaaagaaagtagggaaaaccactagaccattcaggtatgacctaaatcaaatcccttatgattatacagtggaagtgagaaatagatttaagggactagatctgatggatagagtgcctgatgaactatggacggaggttcatgacactgtacaggagacaggaatcaagaccatccccatggaaaagaaatgcaaaaaagcaaaatggctgtctggggaagccttacaaatagctgtgaaaagaagagaagcaaaaagcaaaggagaaaaggaaagatacaagcatctgaatgcagagtttcaaagaatagcaaggagagataagaaagccttcctcagcgatcaatgcaaagaaatagaggaaaacaacagaatgggaaagactagggatctcttcaagaaaattagagataccaagggaacatttcatgcaaagatgggctcgataaaggacagaaatggtagggacctaacagaagcagtagatatttagaagaggtggcaagaatacacagaagaactgtacaaaaaagatcttcacgacccagataatcatgatggtgtgatcactgacctagagccagacatcctggaacgtgaagtcaagtgggcctttgaaagcatcactacgaacaaagctagtggaggtgatggaattccagttgagctatttcaaatcctgaaagatgatgctgtgaaagtgctgcactcaatatgccagcaaatttgggaaactcagcagtggccacaggactggaaaagggcagttttcattccaatcccaaagataggcaatgccaaagaatgctcaaactaccacacaattgcactcatctcacacgctagtaaagtaatgctcaaaattctccaagccaggcttcagcaatatgtgaaccgtgaacttccagatgttcaagctggttttagaaaaggcagaggaaccagagatcaagttgccaaggtccgctggattatcgagaaagcaagaaagtgccagaaaaacatctatttctgctttattgactatgccaaagccttagactgtgtgctaagttgcttcagtcgtgtctgactctgtgtgatcccatagacggcagcccaccaggcttccccatccctgggattctccaggaaagaacactggagtgggttgccatttccgtctctagtttttttcatccatatggtcatccatacatgatcactggttttgccagtggtcatgtatggatatattgactgtgtgtatcacaataaactgtggaaaattctgaaagagatgggaataccagaccacctgacctgcctcttgagaaacctgtatgcaggtcaggaagcaacagttagaactggacatggaacaacagactggttccaaataggaaaaggagtacgtcaaggttgtatattgccaccctgcttgtttaacttatatgcagagtacatcatgagaaaccctgggctggaagaagcacaggctggaatcaagattgccgggagaaatagcaataacctcagatatgcagatgacaccacccttatggcagaaagtgaagtgaagtgaagtcacttagtcgtgtctgactctttgtgatcccatggactgtagcctaccacgctcctttgtccataggattttccaggcaagagtactggagtgggttgccatttccttctccagaggatcttcccaacccagggattgaacctgggtctccctcattgtaggcagacgctttaccagctgagccacaagggaagtcagaaagtgaagaggaactaaaaagcctcttgatgaaagtgaaagaggacagtgaaaaagttggcttaaagctcaacattcagaaaatgaagatcatggcatctggtcccatcacttcatggcaaatagatggggaaacagtggaaacagtgtcagactttttggggggagactccaaaatcactgcagatggtgactgcagtcatgaaattgaaagacgcttactccttggaagaaaagttatgaccaacctagatagcatattcaaaagcagagacattactttgctgacaaacatccgtctagtcaaggctgtggtttttccagtggtcatgtatggatgtgagagttgggctgtgaagaaagcttagagctgaagaattgatgcttttgaactgtggtgttgaagaagactgttgagagtcccttggactgcaaggagatccaaccagtccattctaaaggagatcagccctgggatttctttggaaggaatgatgctaaagctgaaactccagtactttggccacctcatgtgaagagttgatcactggaaaagattctgatgctgggagggattgggggcaggaggaaaaggggacaacagagaatgagatggctggctagcatcaccaactcaatggacaggagtctgggtgaactccgggagttggtgatggacagggaggcctggtgtgctgcgattcatggggtcgcaaagagtcggacacgactgagtgaccgaatgactgacacaaaagctctgagtgatgaagcctcatctctgaccctggattgaatcctcctccagaggccaaggatcctggcggctttccgtgattcagcaacaacttttcagtagtatactcatatacgggcttcccagatggcactagtggtaaagaacatgcctgccaatgcaggagatgtaagagatgtggcttcaatccctaggttgggaagaccccctggaggagggcatggcaacccactccagtcttcttgcctggagaatcccgtggacagaggagccttgcgggctacagtccatagcgtcacaaagggtcagacacgaccgaagcaacttagcatgcaaactcatatactaccccacactacaccacatacaccacaccatacactcataccacagtggggaaaagcagctattactacaaactgcaatgtggataaatctcacacacataatgtggaggcaaagaaaccagactcaagagtcctttaggagagtccaatgtaggtgaggttcaaatacaggaaaactgtgtgacaggagtcagaagaagagctgcctttggaagctgggtattgtctggaaagggtggaaggagcccttagggtggtggaaatattctatagcctgattggggtggtggcaacatggtgggtatactcaccttgacaaagtcttaattaaggtttgtttcctttactgcaggttttactccaataaaaaaaaaagaagaagcaaaagtattaattttaaaaatagagagtctgattcaataggtattgtatggggtccagagatctgaatttttaacaaagtttgccaaggtaacataatgctggcagtccagggcctcaaccccaccttggacaagagataaggctggtccagtgctacggttaaggcataagacagaatggtttgaacgacaccccagtggatgatctgttgatgagaaggttcttacaagaacttctagctgataaatccagctgcgtaagtgtaaagataatgggtgaacttaatatacatgaagaggcaccaatagactcaggtaagtggcctcagagttccctaagctgtgaagcactggattcacaggctccaactcctccagctctcccttcccgcttctagcatttatgggcaggtccacctggtgtttccagtagtcatgtatggaagttggaccataaagaaggctgagcaccgaagaattgatgctttcgagctgtagtgctagagaagatgcttgagagtcccttggaccgcaagatcacgccagtccatcctaaaggaaatcaaccctgaatagtcactggaaggactgatgctgaagctgaagctccaatattttggccacccgatgcaaagagccaactcactggaaaagaccctgatgctgggaaagattgaaggcaggaggaaaaggaggtgaccgaggatgagatggttggatggcatcaccaactcactggacatgagtttgagcaaactctgggagatagtgaaggacagggaagcctggtgtgctgcaatccttggaatagcaaagagtcggacatgactgaacgactgaacagcctggtgtctgtgacagattaggggtgtgacagttaggacccctgcagatggccctgtggctgcctgaggccataccccgccggggggccccatagcctcatggccattttgaaggctgcccagtctcctataggctgtgtcctggagcaggcatcagcacagagctcagctacataaaactctgagcagcttgttgctggagatccctcctgaatcatggtgctttcttaaccactgcaggtttgggcagagtcacaccagaaaagggggcgaaggaggagatgaaagttcagggacacaaaggcacgtatttgggccagtgctgacttgttccacagcttctaaacctcttatttttatggtggttacactaagctcagtcaagcctaaggtaagttctgcatagtcaggccattttgtttctccttctctcttgtgtctctaccctctggaatcctcttataactctatgctgaacggggcaagatccccgaggaaatgcactttgaccaggagctctgtgcctgggaccagccgctttctacggcatctggcgaacagctaccctgaatgggtctctctgcctggctgctctgtctctttcatggtctcaaactcaagccagtgttttcccttgaaattgttctcagcttttcctgaaccctggaagctccttcttaaggagaaacaaaaagggagggaggagcaactcgtcttttaaaacctaaaaatggcctgtgtcatccagccaggtaaacacttcaccttcttaacaggttccttcccagaactggaactgggaattaacacaggacctggaaggtggaatgatggtctgcaaggcacaatgcccacagcccagaaggtggtgatgaaagctgcctttgtacattgcccacccatgtgatcatcaaacagaattgttccgacccagctcgggcgctggtctgaaggctgtcaggcattttagaagaatcagccagctgccacgactgcccataaaagatttttgcatatccagtgttgcctcaccttaaattgttctaaaaaacaacaaaaaagttttctgtctcagtctgttgtaaatgagggggttatgggaacatggcgggagtgattaggatgccttgctgcctgattttattactttaatgtgcttcaatgccaggatgtgccagcaaaaataaaggcaaagatacaccatctccactgcccattattgggcaacaccaagggagtatcgccctggtcatggtcattatcagacgagatgatgggataaacacacaggcattaggggtgaataactgacacggctgccataattaagacatcatatgcagttttattttccgatgctggtatttttacactctgggctaaggtttctcagcagagttctcagtctacagggaaatttttgtatgtataaatttctgataaaatcaaattaggcagtttgagagatcagagtgtctttttgtttccagttaagacccaagcacttggataacccagattcgtaggcccgcctttcgaaatggaacatttctgagtgcctacgacgatggtcactctcaaaagaaaagcactggtgcctctgacatgttctgagaaatctcgtctaccccagagcccgtttgcagcattggaggatgttggtaattctactgagtcctggcctgggcccacctcccacctcccagcctgagctgtaaaggttcaaatgtcgctacaaaggtcagcaggtcttcagaccggaacctactctcacctcctctttacacacttaactccatttagagtttgcggaggagcattttggtaaatttcctttcagtgctttttgcttccagccaacgacctttccaaggctgggctggagggacacataaggagcaccagtcacccccacctgccactaaagtcactcctactccccacggcctgtgagggactgtcccccaccccacctgacaaatggatgatgaccctctggtggctccagatcacactacctgaccctccagctgaatcccaccttcagggtctctttctagaaaattccatgagggcctaaaaggtaaacacattctgcaaaggaagcatttttccttactccacgtaaaggtcatgaaaaaacaattggaggggacttccctggtgggacaatggatgagaatccacctgccaatgaagggggacatgggtttgacccctggttcgggaagatcccacctgcttcagagcaactcagctcgtgtgcagcaactactgaagcctgtgcacctagcactgtgttctacaacaaagagtgcagccaaaataaattaactgttaaaaaaaaaatagttcaagggtggagggaagataaaggaagaggcaataaactggaagtactctgtcccttttctgacaactggttttcaaccaagaagatgagagtgaaaagtgttagttgcttcatcatgtctaactctctgtggagagagttagcccacctggttcctctgtccatggagttctccaggcaagaatagaattttcatctcgtgtgcaggaaagtgtcctgtagaaacacaggaggaatccgggggtcaaacagctaatgtagtcaactccatcccagggatccagagaaaatcagtgagtaatgatggacggtgttcccaacattctggggaggacttgctgctgtttagttgctcagtcatgttcaactctttgcgaccccatggactataacccaccaggctgaataaaagagttgctgatctgaggaggtgaaggtcagaagacagtttgatgtgggaggccacaggcagccacgaagaacagcactcccccaagaagaatgatgtggtcaaagggctggtcaggactctcctctgttggcagctgcccccgtggaaggctggagacagcacagccagagaggaacagctgcagccagccggatgggagccgactctccactccaagacctgcctgcacactcccatgaactcctccaaggtcctctgcaggaagcctgatgccctcatgtactttggggcctggcgatcaaacccaccttgcaaggccaatggcagagatcctgcctcagagctagacaggcagccctcccgtgtccacggttcctgcacacacaccatcttatgactgactccaggggtggctgagcacccgtcctggaaggtgggagctataaactcaaccccaggagggtgggagggtgagctcggggtgctggtaaagagaaatgtgggtgcagttctgcatgtgcacccctagagcacagcctgaacccaccatgtccacctgcccctaggagcgacaggtgggagatgctcctcctaggtctttccctgctcccagggaagcaggtgggagctccaggatctccctaaccatccacacagccagtgtctagagccagggacccgtcttccttcagccaagggtcccacaggacatggtggagttccaggcccacggtaagcactccatgtgtgaaacactaagggcctgaatcccatggctccaggcacctgaagcctggtccacttcacaaagtgcctcccaggcccgccttcctctctcttctcaaggccaatgtccatgaactcttgatttttttaaaagctcacaaagataaggtgctgaaatggaagacctcgtgtactcacgaatcttcagagcttcctaagggacatattttcttcttaagaatggaggaaatctctcccatttttgagccatacttttatgacaattctacaaaattgcatgtaactttatattttaaaaagatacagttttgtaaatatttgtatgtacatatattacaaatattccacttgtttgattttgaattacagatgtcaaatattctgttttgggggggttatgttttattatactttgttaaaaaaggaaaagttgtacatttttagaatgtttgtatgagtaaatttaatgtactggaaataaaaatttaaaaaagaaaaaaagctcacagtgtctcacaactaagagatcacccaaggagagcagcattcaatgggagtggaacagaagaaatggcagcgaggcgggagggggaggggagacggaggggagggaggggtgggggagaaagaaggaaaaggacaggggagggaagtgggaggggatcagaacacgaggcactcaggtcatgggcagcaaagtcttcccaaagcctcttggatttgaggtttgacttaaaatgcaaaatttaaatcaatctgaaacttcctggttttgaataatctgtacgtttgacaaaacatctatacaattcttcctgtttgccagacaccttgaagtttctgttttgagcaacatgagatctctcggaggcaacgcagtccaggaggatgggtggggggccagggagggccagtgtgaacttgggtcccactccttactaatcgagtggcctcgggcaaaccatttgttctccccaagcctcattttctccatttaaaagccagggatgagaatccctacacctcggaggatctctaggtaatacacaccggagtctcctgggcacccaataaaggcggctattaaaattgtcattagcatcatcattcctcttctaaatctgcagggcccagaacaattagggaatttaggatactttttaacaaggctcaattagtgtgattttcatgccaaattgtataggccttaaagaaatactgattttttttttgcgccccaaaacctaacgcctcctgtatctattccaagtgaaaattaacaacgtaagtagctttcttaattgcaaaagcaaacagatcctcagccaggaggcaaaacggcagagccccagcctggcatttgtatctgggagttaccccagcctcttggggaaaagtccagaggaaagggcatctggaaagctgggggcacctgaccgacagcagggctgaggagcccagggaaactgctttcttttcaagaaatgatgccgcaggcctccgtcatttgtccaccatcatctgggcttccctggtggctcagagggtaaggaatctgcctgccatgcacaagacctgggttcgatccctgggtccagaagatcccctggaaaaggaaatggcaacccactccagtattcttgcctggagaatctcatggacagaggagcctggcgggctacagcccatggggtcgcaaagagtgagacaccactgagcaactaacactttcatctgagggagggtgagtttcatataatgagggaagaaggcaatcccttccccatcaggacttggtgttcaacatgctggaactgcagatccacgtggagaaaggctattttaaccaagcagaggataaacaaggaagcccatctcttccttgtcaaactagaatgttttggaagcaaaaagtaagtaggtaagtaagtaaagtcactcaaacgtgtccgactctttgcaaccccagggactgtagcccaccaggttcctctgtccatgggattttccaggcaagaatactagagtgggttgccattttcttctccaggggatcttcacaacccagggatcgaacccaggtctccagcattgcaggcagacactctaccatctgagccaccagggaagcccttcggaagcaaatgcccccccaaatcagcaattttgaaggtaatctctaaaaagtaacacttcttaaagccctgttctgtcttcaagtctttccaaactatttatagacatgggcctctcctctcaatggaaacagtgacaaatattattttcttgggctctaaaatcactgtggatagtgactacagccatgaaattagaagatgcttgctccttggaagaaaagctatgacaaacctagataagcgtattaaaaagcagagatgtcactctgcagacaaaggtacgtctagtcaaagctatggtttttccagaagtcatgtacagatgtacgtgttagaacataaagaagggctgagcaccaaaaaactgatgcttccaaactgtggtgctggagaagactcctgagagtcccttggactgtaagatcaaatcagtcaatgctaaaggaaatctattcattggaaggactgatggtgaagctgaagcttcaatactttggccacctgatactaagggccaactcattagaaaagaccttgatgctgggaaagattgagggcaagagaaaagaatgacagaagatgagatgcttggatggcatcaccaactcaatggacatgagtttgagcaaactccaagagatggtgaaggacagggaagcctggcgtgctgcagtccatggggtcacaaagagttggacacaaattagcaactgaacaacaacagatcctctcaaactcttgtaagatgtcctatttctactcccatttcacagatgaagaaaccaaggctcagggggactaataaacaacctgcccaaagacccaaacatgattaggtgaataaagatcactcatgttcttgtaaactggatccagttaatgatcgcaactcctctccaagccttcaagatggaaaccagactcctcaccaccacccttttcctaaacatcactcagaccccaacacagctttctccttcaaaattctttttgcccaggtctcctagcttcccacccagattcctgcagcagtctccagatgggtctctccttcctgggatttctagcccctctgatctttcctgtatcctggacaagacgaacccagataaaatgccactgtctgagctcattctgccggaatgttccccaagtgcagattccagttatgttgctctcagttgtgtgtgacatgggcaaggtacctgacctcccagggcagctctttgctcatttacaacagaaggttaattgtgcctgcccctccatgtagggtgagaatgaaacagatgttatacagaatacacaggacggtgccagacatgaggaaacactcaataatctgttatgcctcccctcctttcctccttcgccttcctccccttctccctcctcctctccatggtctaatagatgccggccagtggagccaatcactccccttaaatgctgtccttcaatatcccatgtcaccttcctgtccaccccgccaccacctcactcccactcaagtcaggtcagtaagttctcccaagctctggacccttttctgtgactctctggtcagtatttctttttgccttttctgaagtccgctgaccatactatcctcggctctgcccggtgttgcaccaaactgttccttgattatttcctattggttccattcctttcagggaaaaccatgccagactccatggaaccaatgattaacggcagtgcctgggacaggttcttcccacccaccactgacagcatccactgcacacagccaggctatggaaccattccaggaaaactcacgttgaggagccagtgatcactgtactcagaagttctaggaagctccttatcacgaggagttcattgaaatacaggggaaccagtctcacccccggaaagggttatcagcaagcccagcctcatcgcccccagttctctccccaggccgtctgtcctggggctcctttctcctcccacccaaaaggacaaggcctgggtgatctggtttgtttgggactgtgatgatttaaagttggaaatccctcatcagccccctcactaagtctcaggcgtgctaggatggctggtcaccccactgtccactcagatgacagctttgttttttgagagggtcataaaaaagcattagtaacaacttccgagtaacctagaaggaggaaaggaggagaaggggatgacagaggatgagatagttgggtggtatcactgacttggtggacatgagtttgagcaagttctgggagttggtgatggacagggaagcctagtgtgctgcagtccatggtatcacaaagagctggacacaactgaactgagtaacctagaagtggggctttgctcctcccgaaccagaaaaacttcagcacagatgaacgtaacccattgatcagattaggtagctgatccttgaaagctgaggatccaggactataggtccctggaagagagaacagatgaacagaggttgaagtccatgaggggtggggaaagaagtgggaatttaagacaatcttggcaaactcctcagtagctcagggtcagctattaaagaaagggccttcttcctcccgactgtcagaccacctttgggaaagagaagcagttaaaaatcagtagtgcagtgcagttaacaaatgttccccagaactgcccatctctgaatgtgatcagtgcagaaacactaactagaaaaagatatatgcacccccatgttaaccaagatatggagacaaccaagtgtccattggcggatgaatggataaagtaatatgatatgtatatatcgtgctcagttgtgtccaactctttgcaaccccatggactccagatacattcccttctccagctacatatatcatcaggtatgtgtgtatatatctttaggtatgtatatctagagaaggaaatagcagcccactccagtattcttgcctggaaaatcccatggacaaaggagcctggacagctacatacaatccatggggtcacaagagtcggacacaattgaacgactataccaccactaccctctctctctctctctctctctctctctctatatatatatatatatatatacacacacaaaattgaatattattaatctataaaaaagtttgaaatcttgccattagtgacaatggagatacttgccattacagacaaaggagagaccttgagggtttttgaggacacaagaagacaaacaccataagatctcatttctacatgggatctaaaaaagaaaaacttcatagattggtggctgccagagatgaggagggagggaggtgaaatgggtgaatgaggtcgaacggtacaaacttcatgtattaaataagtcatgggaatgtaatgagcagcatggcaattatggttaatgatactgtattgaatatttgaaagttgttaagagagtagatcttaaaagttctcaccacaagaaagaaaaaaaatgttgtaactctgtgtgatttatgttaactacacttattggggtgatcactttaaaacatacacaaatatcatatcatgatgttgtacacctgaagctatatcatgtatgtcaattatatctcaattttttaaaatttaagaaattaaactgaaaagttattaaatcaatggataattgaaaaaactgccctccatcatggacaccctggatactgagttaagcctgcattaaaccacagcccctggaagagtcgttcattcagcatttcagtcaagatcttccagactctcaggtttagcctctgaagttccaggtaattgaggaaatagcaaattgaaatgaaatcagaacactcccaacatggggatgctaagactcacctttccacagcatgacatattactatgcatcaatctcctatttccttctaacggcgcttggttcagtagactgaaccaaggggaacttccctggcagtccattggttaagactcagtgcttcagcttcagggggcacaggtttgacccctggttgagagaggaagaccgtgcatgccactcgatggagccaaaaaatcataaaaaattattaaaaaaaaaatgtgccagcaggtcttgggcctagtgaagtacttaaaaaaaagaagaagaagaagaaaactgaggggcctctgagagactggacactagcaaaaggtgctgttccttcctcttaaattagaggatgaaaaccttgaattattttcaatattcttgcttaattgagggcttatttcttttctttttttttcttataagatgacctaccttatttgagaatcatcagtaaagagttgagatttaaaaaacaaaaaactgtagagcagatatatttatattggcatagtggtttcttaagattaacaatcataaccaccaggtgcacaaagagagggaagtgggtggagtatcactgagatctgagaaatataataatgaaaaccactttaaacaggtagtgcaattcatgtgacaaacctaccccagaatagcccatctctgggtgtgacagacactccagactaaagggtaccacacagaggagccagaaaccatcacctgctcattcttaaatccttaaattaagctcagcaaaggccatgatttctctttgaccctccatatgaccctttgggtcaaaaagaacagccaaaacttctgtccctaacaggaaaatctaggtaccccacccgcctcaggtcagcagctggaagaaaccctggcaaacctgaatgtccacctcccctagggaacttggggctgaagtgttcatcactctgtcatgtccaactctttgtaaccccctggtctggggaattctccaggcaagatactggagtgggttggcattcccttctccagggaatctttccgacctagggatcaaacccgggtctcctgcattgcaggcagattctttaccatctgagttaccagggaagcctctagggctgaaaagatcagtataattagtaagtggcagcttggaactcagctcccatctttcattgtaaaaaagaagacatataagtagaggcatcttctcaaaatagttcatccaaggccctaagagattcgcagattcccaatctgtcttttgacaatgtcattacaaacaaaatagctgtgttatgaaatgatgatgttgatggtaatggtgatgatgatagcaactaacacagagcctttactctttgcaagtcctagttctaaacactctactgatattaactcaatacatcctgacagcaactctattagatgcatacactattactatctccatttgctggtgtgaaaattgagatacagaaaggttagcgtaacctgtctaaggtcacattgcaggccttgaacccaagagtcatctagagtccatccttttcatcccattctagacactggctcatgtccaaatggagaggctctagctccctgggtgggcaagatccccctggagaaggaaatgacaaccgactccagtattcctgcctggagaatcccatggacagaggagactggtgggctacagtccatggggtcataaagagacacaactgagcaactaacactttcactttctttccagctttttttctttccagctccagcaagatccctcctcaggattaatgcctctagggctctggctgggttatctgcttgtttatcttaacccacttcctttcagtaaggtaatttgcaggatcagatcagatcagatcagttgctcagtcgtgtccgactctgcgaccccatgaacccattataaaacacacagcagagggcttccctggtggctcctggtacctgcctgccggtgcaggaattcgatccctggtccgggaagatcccacatgcctcagggcaactaagcccatgcacaacagctgagcctgagctctagaacccaggaggggaccccaacaattgagctcaggggccacaagtactgaagccctcacgccctagagcccgtgctccacaagagaagtcaccgcaatgagaaacccagggaccacaaccagagaaaaagcctgcgtaacaaagacccagcacagccaaagattaaataaatacataaagtcttaaaaacacacagcaaaagctagtggaaagtgcagagggcaaatagtgttgggacactggacagtcctggggggacaactttggtggccaagtgggctgggtgctggagaaacctctggctgtgtgcaacaaccctctccaggaaacttctgcaagaagtcaccgtgacagtgggttcacactgcgtgctccagcccacacgtggagcgcaaaccgtctttctgcccgatgaacgacaggtctccctccttggacatgcacagccatgcagggctggcatcgacctgcgaaaactgaggagtcaagtcctgcaaagctgtgctgcaaagcccttcttccagcagggcaggcagagccaaggtgttccttgaaaaacccttgttgaatcgactctaacccagcttatcacagtccctgcagcacgtttcatgtcaggtggccaaaagagtttgggtctgggatttttaaggcaagtaaaaccaaatgtctattcttggccataaatagctttctgtaaacccaccagtccatcctaaaggagatcagtcctgagtgttcattggaaggactgatgctgaagctgaaactccaatactgtaaccacctgatgcgcagaactgactcactggaaaagagcctgatgctgggaaagattgagggcaggaggaggagacaacagaggatgagatggttggatgcatcaccgattcaatggacatgagtttgagtaaactctgggagttagtgatggagagggaggcctggcgtgctgcagtccatgggcaaagagttggacacgactgagtgactgaactgaactaaaacacaaaagaaagtgttgaacacaaagcttgacactgcctactgtagaaaaatgattttttagacttgtctttctcatgtcagagtccaagaaggcactggttaaggaggaccagtgggcaatcgcagaaaaaggcaggaaaataaccaccaattcactttccaagtaggtcttttgctgttgtcgctgttattgttgtttgttgtttagtcacaaagtcatgtccagctcttttgtagccccatggactgcagtctgctaggctcctccatccacaggatttcccaggcaagaatactggagtgggttgtcatttccttctccaggtgatcttcccagttcaaggattgagcgtgtgtctcctgcattggcaggcggattctttaccactgagacacaagggaaacccaagtaggtctatgcctgaccacaagtcatcccagccatggcctgtggtgacaatggtggaatatgaaagaacaaatttaaagactatttgctgcttcagtaagctggacaatgacccctcaaagatgtccacatcgtaacactcagaaccggtgaatggcaacaaggttatgaatttgagatggggaggtttccctgagctgtcaggtaagtgggcccactctgaccacatccatccttaaaagtgagaaccttttccagctgcagtcagcgaagatttgactagggaacagtagtcagagagataaacctgctggctttgaagacggaggaagggggccctgagttgaggaaggcagaagacctgcagaaactggaaaaagcacagatgtggattctcccctgagcctccagaaaggaggtctaggaggcaccaccttcttagtggtgccttagttttagcccagggagatgtgtgtcaaacttttgaccaatggaactgtcaaataatacatctgagttggttaaagccaccgagtgtatggtcatttgttacagcagaaataggaaactaacacaactgatgatgattccatatgggaatcctgaacctttttctaagacgattcagtggatcaactgcaccccagtcacgcagaaggaccctgaagcaggcagtatgtggcctatttctggaaacttcctgcacgagcctctcctcaaggccaaggatttgcaaggttgacaaacagccaagctaagaccacagcccctctgtgtgggcttgagaatacaatgacccctttgaaatatcgggaggcttgctcattccttcacaccaccccttagggccacatggtctagcagaccagctcctcaaagagctttctacttgactctgcaggctatatactttgctctaatttcttaacctggtaaaagcgatccgaggatccatctggccaaaacctaagaaggcatagtcccagatcatcctctcaagaggatgaggaggtccactgtgatattctgctctttttattcttgtttcctcccagtggtttttctagaatctgccttctcaaaaaagagctttatggcttcaagccatggaacgtgttcaatagacctggcgctccctagtggtcctgagatgcactttctggcttaccaccttccctttagacatatccatacagtccatcctataggaaatcagtgctgaagattcgttggaaggactgatgctgaagctgaaactccaatcctttggccacctgatgcaaagaaccgactcattggaaaagaccctgatgctgggaaagagtgaaggcaggagttgaaggggacgactgatctgaactgaactgactgaaacacagttgtgacccgaacagtagtggctttactgatgcatttcaagttgagatcagcagctgatgtgtgcacactttgttcgtgataggaaaatagcaactgaagatttgtaaactacttaggagagaggaagtgtgaagagtggaagagtagggtcaccccatgtgctaggcagaaccaatcatgaaaaagaaattctgattttctccagaaatattcagattaaatgtgttcagaagtctctagctcgtttgcataattatttagaaacaagggcttccccagtggctcagtggtaaagaatccacatgccaatgtaggagacatgagttcaatccctgggtcaaagatccctggaggaggaaatggcaacccaatccagtattcttgcctgggaaatcccatggacagaggagcctggtaggctacacacagttgtatggggtcgcaaagagtcagacagaacttggccaccacacaacaacaacttagaaacagtcagcctcctgaaaactttaaaaaaaaaatccctctctattttttctttgtaatgtctgtaagttttaaagagaccaaaggtctgaaactatctatttacaaagatgaaagtctattgccttaaagacacagtagtttgatgaccaacttatgaaaattgtttggattagagtcaggaagggaggggaatggaaatttcatatattttgttctaacttaaactagtcagttaatcagaaacaacttaaaggttactgagagaattcttgtgaccaatgcttttaagattttagaatgtgttccctttaatgcttaaagatggcagaaatcagaggctttacgcttaattttttcaggtagaaaggaggaatcacctgtgtggtatgatatgtgagttctggaagaatccacatgtctaaaaatgcccacaccagccctccgtgaaagcctgaatctcaaagaactgtctagaaaaagccactgtctgttaagaagtggcagtggttatcttccccaggactaacacaggaaaagacaccagtcccagaaacctctaacctttccacaagctgacactgtttgtctatttacatgaaagggtccattttggtgacattttctacatcttcttacaggtgtttgatgaagtggcaaagccattaaattctttttgtaaaggtatgcttgtcagatcttattctaaaagattcaaggcacttttgagaagccacattaattactatagctggtcactatagtgatgaaatatattcaaaatgtaaaactaaatcccaaagactttgaatagccaaagaaatcttgagaaagaacattaacattggaagctcacacttcctgatttcaaactacattacaaagatatagtaatcaaatagtatggtattggcataaaaatgggcacatagatcaatggaaccaaatagagagcccagaaataaacccatgcatgtatttatagtcaattaattcacaacagaggagccaagaatatacaatgggggaaaggacagtctcttcaataaatgatgtttcttaaactggacagcaacatacgaaaggatgaaaccagatcactattacattacacaaaaaaaaaattattcaaaatggattaaagacttgaatgcaagacctgaaaccacaaaactcctagaagaaaacatatgcagtaagctccttgacatcagtcttggtgacaacttttttcctacttgacaccaaaaggcaacaaaggcaaaaataaacaagttggattacatcaaactgaatagcttctgaccagcaaaggaaaccatcaccaaaataaagaaacaatttactaaatggcagaaaatattttctaatcatatactgataagggactaatatccaaaatgcattaaaaaaacatgtaccaactaacagcaaaaaaccaacaatctgatttttaaacgagcagaggttctgaacagacattttccaaagaaggcatatagatggccgacaggcacatgaaaagatgctcaacatccctcatcagagacacaggagatcaaaaccaccatgagctatcacctcacacctgttttagaatagctattatcaaaaagggcttcccaggtggcacagaggtaaaggatccacctgtcaatgcaggagacacaagagacacagcttcgatccctgggtggggaagatcccctagagtaggaaatagcaacccactccagtattcttgcctggaaaagtccaggaacagaggagcctggcaggctgcagtccaaggggttgccaagagtcggacaccactgagtgactgagcccatacgtcacattatagacaaaaatataacaagtgttgtagaggatgtggagaaaagggaaccctagtgctctgtaggtgagaacgtaagacggagcagccctatagaaaacagtacgcaattttctcaaaaaattaaaaatagaactaccattagatccagcaatttcattcctgggtatttatccaaagaaaacgagaaaactacctgctgctcacaggtcaaagaccagtggttccagttgtgcccttcttctctgctttaacttttctgtagggcagagagagtgctaataagacaggaaaccacccagttggccctctggaccttggtcccgtctcgtcccttttctgccctctagtggagcaacaaaacaggaccgtgaggacagcaacaaccaagaaaacacctactgccagaaacaagttttttctttaaagaaataaacatctgcacagttgctagcactttctagatgactttgtacacccaccagtggctggagtcgtctgtgcccagtggaggggcaggctttgctcatggtctgtctgtactttatcagtaaaattgttcattagagtcctcgatccacgtcaccaaggggactatgccctattttaaagcatggtcctcactcctccataatcttggaacatagggatggcttcattcctcttcacacttagattttaagaaatctattttagattctaagatctgaaaacagatctgaaccctaaatgcatccccaagtatcagttcagttcttgctcagtcgtgttcaactctttgcaaccccatggcccacagcaagccaggtctccctgtccatcaccaactcccagagtctactcaaagtcatgtccattgagtcagtgatgccatcccaccatctcatcctctgtcgtccccttctcctcctgccctcaatctttcccagcatcagggtcttttcaaatgagtcagcttttcgcatgaggtggccaaaggattggagtttcagcttcaacatcagtccttccaatgaagtgatgggaccggacgccaacttaggacatgcgacttagcactctcctaagctggtaaaatctgagcgggtgaaaagatggccaaggggagaggtccagagtgggtaagagcagttccgaggggcggggggcagaagagatgacaggagggctgtatgtggccaggtcttctgtttggtgcctgcgtttcccctttgagtcactctaagcaacggaatacgctcagtcattcaagaaagtaaacccccaggggatagcaaaatgggccgcattattaagctggctttccagaacaagaggttcctttgtggtaataattccttgtgagaattttacaaggaaataggcttttcatctctatgtgaaagcttcagttggtatcaggccatattattaaataaggattaaaaatagccctggagtttttaaagcataattcctataggaggataaatagcgagtttcattgtgttggtccacttacttcttatgagttgattccacccgctgtgaccataaagactgacacacaacctagcctttggtcagaatttaaagctaagagcaactgggttcagtgattaagttatgtggatcaagggtggtcacccacctactccacctaataagacattgattgttactacaggtgaaaagagagttggactatgaagaaagctgagcgccgaaaaattgatgcttttcaactgtggtgttggagaagactgttgagagtctcttggactgcaaggagatccaaccagtccatcttaaaggagatcagtcctgaatattcattggaaggactgatgctgaagctgaaactcaaatactttggccacctgatgtgaagagctgactcactggaaaagaccctgatgctgggagggattgaaggcaggagaaggggacgacagaggatgagatggctggatggcatcaccgactcaatggacatgagtttgagtaaactatgggagttggtgatggacagggaagcctgacgtgctgcagtccatggggtcgcaaacagctggacacaactgaacgactgaactgaagttgcatgtcccagttaccaactgtccaggaaaacatcactccacatttaacagcctcaattgtctgttttattatatatcatgatttggtgagtcaggaatttggggaaggcttgcctgaatgatgcttctgtttcatgtgacattgacaaggtcactcagtggtgttcagctggtgaaccaggtgcatgacagcgtcacacacctgtcaggtgttttggcagaatggccagaaggccgtcctcagctgggactgtcaagtgggtacctacaggcagcccccagcatgctggcctcagggggggtcagtggacaaggcggaagctgcatggccctttgaagtgagagccacacagcatcactcctgccatattttcttggttaccaagtagtcaccaaggtcaggccatattcagagggaggggaatcagagcccacttcccaagggtctgatgggaggtccgggaggagggtcaaagaatttgcagccatcttgaattcaccacactatctgatttcagagtgtgctgaaatgctcaaaccatttacttatagattcaggtctttactgaagttgctcaatcatgtcagacccctgtgaccccatggactgtagcccaccaggctcccctgtccatgggattttccaggcaagagtagtggagtaggttgccatttccttctccaggggatcttcccgacccagcgattgaacccgggtctccagcattgtaggcagacacttttaccatctgagccaccagggaagtccagggctttactaacttgaaccaatttaaaaaaatttttttagccgggcataaaagcaatgttgttgtttcatattatccagtgatgagcagggcactgtacctgtactactttttacagcaagtctcactagctggagagtgacagaccaaccttcctttcttgttgctgctcacgatgcaaataaccataacatactggttaaaatgacattaaccaaatatcatcctcctccatttctaatgtgtcaatacctctaagttttctctttttttcccatggaaagcaaaggtgacctttattcaaatggtaaaaaagaatgctttctgcatgacgcccaaaggtgatacgaattttagaaatacattttttccatgaaagacacacacacacacacacacacacacacacaataaaggagagagattaagattaagggttagaaatatgtatcacaggtgattaattaagcactaaaaagtatgcaggaatacattcactgtcatttttttaaaccaagtaatttcaagtggagaatattaagtaaaagctcaattctttcaattaaaaaaatttaaaaagcggtggacagaacatcgtatgactgaccaaacaaactttttatattgtcaaacattctcataaatatgtctatacacacacaaaggcaagcaattgggggaaagaaaacaaaacgtccaattctttttgaataatgtgatgaaagaccaataaaagcactctacttgctgcatacaaagggttctcacagacaagttttgattaacagagtagatgtctaacacagagacaaacgtgtatgtgtgtgtgcacgggcatgcactcagtcacttagctgtgtccaaccctttgggaccccatggactactatagcccatcgggctcctcagtccatggaattttccaggcaagaatactggagcgggttgccatttcctactccagacctctaagttttgttaagcatggaattctctgctcagagagttaaatgatagcaaaaagccactgagtgcaacccaaacttcatcttgtcgggtaatttatgggaagagagttgaaggcatccagcctggatgaagttcaaatgaaagggacaaagtagaggagagataaaggctttcaaagattctttgaatccaccgcatccgaggacctgacacccaccgaaaacacaaagtgttaattgtcctcatttagggagaaagcctgaagtctctggctctccattctcaccttcatgctggatgaccttcacagcacttggcagctgagctgtgctgggtgtcttggccacgcccgtggccactgtcctaagggccccatccgactccctggtgcgcccacccagggtgcctccgtgtcctgatttctcatccccacagcgctcggtggttggaggtggactgaggaactgtgggtggctaggggtgcacagcgagggtcttcctactggatcgccaagaacctcacaggccagaggcagagtcccgcaggttcaaaaaagggaacccaatctctggcttcccagaatagccctaaacttgcacactctaagtgaaaagggtgcactgaggctagtagctccttaaccagcacatactgcttctcctggataagaataaatggctgccacttagacatgacaaagaagtgactgtaaaaagggcctatggggacttccctggtggcccagtgggtggggctccatgctcccaatgcagggggtacggaggttcagcccctgactggggaacaagatcccacatgcccgccacacctaagaagttcacatgccacagtgggggtctcttgggccatggctaaggcccagtgctaccaaaataagtagataaataaaataagtattttgtaaagggcatatggagtggcccacccaattttttccacatgatgtaacagccatgtttgtcattcatccatccactgagcacagctggtggctgagacggtcaagaaacctcctgcaatgcaggagacccaggttcgatccctgggtcgggaagatcccctggagaagggcatggctacccactccagcaattcttgcctggacaatcccatggacagtggagcctggcgggctacactccttggggtcaaaacgaatcggacacaaatgagcggctttcacttttacttttcaacaaaaggcggagccctcactgtttgagatctagagaccacacatctcctttctgttggtcgccgcccagcctcccatcctgctcgtcccacctgtcccagctaactccggccccagtgctctcctgcctcataaaacatcgaagttatttcctcccagatcaccctctaaggctgaaagctccaaaatagaaggttctgtgttcatcaacactggcctcaagcagtgttacatggtgtgtactcctgattcaactttaaatagacttcttgttgatcagtcactaagtcatgtccaactctttacgaccccatggactgcagcacgccaggcttccctgtccttcaccatctcccggagtttgctcaaactcatgtccattgagtccgtgatgccatccaaccatttcgtactctgcagccctgctctccttttgctttcaatccttccccgcatcagggtcttttctagtgagttggctctttacttgggtccaaaataccacttggtagttagaaagactgaaaagcagcttttacgttgccctacatcaagactcagctttcacacagatgaccaactacagaagaaaagagaaagagttgaaatagagcccataaaactagtaaaaatggagaatttttgtttttttttttcctggctttcaactttttatttcatattagggaacagtcaattaacaagttgtggtagtttcaggtgaacagcaaagggactcagccatacatgtatgtgtatgccccaaaaccccttcaaaaaatggagaatatttttaatctcatgaccatgcagggatatttaagatcagacttcccttgcagactgagtaagtatgtgcccacatggtctgcatttcttcacagagctacactttcagaagcttcaaaattatcttttcaaacaatctttggtatttgtgtatctccatcctctctctcatctgacagaagccacgggtaggcttccgcaattccctggtcctctgcaaataggacttgtcatccatctctatacattgtggtcaattctttcaacagatggcatccaaaaaagaacacctggctaggaggcacaatgttagaaacagtacttcaccacagataattatttgtcatgaattcatttcaggagatggcaagatcaaagggatatacctctacattttcaggtggagcagtgtgggtgtgaaatgatgctgctatctatacattttaaactttgtttgaacaggaattctaataatgtaggcaagagtttgatcctgaaaggatgtgtgcttgataaaatgtaaccttctaattaaaaagaaagggagaaaggcaagatttgaaatacctaatccttcaggacttaagaagttagaaaataaaaagcaaaacagagcatttaaacttttcaggaaatgccgtttctaagagtgctgtcacagccgatgctttgttttcccaagtatccattacaagaaattactaaagcaaaaaggatacattactccagcacaaatagtcaaaacagacaggggtctaacttccttaatataaaaatcaggaagaacaagaacaaatttcaaaggcaatttgaaaaatgagcaaaggacataaacaacaaaggatagatcacagaatagatgctaatggtttttaaatatgtaaaattaaactcagtctcatgtatactaaaagaaatgtgcgttaaatgacaatggatctcatttttcacttctcagattcaaaaggtagggaacacactgagcaggcaaggatgaggaagcagacacagcactcatggcgggtcaggggagcactgtttggcataacctctttggagagcaaatttaatacacgttaccagaatcttaagtatgcacatccttcctcttagcaatatcatttccaagagtttaggttccatatacgagtatacatctttggatggattttcactacagcactgcttatcacatgagaaaggggaaacgacctaaatatccaacagtgccaactgagagtagaatacacccactacgagaaaaatgcaaaatgttaacaagaatgtgagggagctacaggcaccaatggggaatgatgtccaagacacaatgttaagtaaagacagcaagatgcaaccaaatgtatttccagtgcactacctttcatggcatctggtcccatcacttcatggcaaatagctggggaaacagtaactgactatatttttgggctccaaaatcactgcagatggtgactgcagcaatgaaattaaaagatacttgctccttggaagaaaagttacgagcaacctagacagcatattaaaaagcagacacattactttgccaacaaaggtccatctagtcaaagctatggtttttccagtagtcatgcatggatgtgagagttggactataaagaaagctgagtgccgaagaattgatgctttcaaactgtggtgttggggaagattcttgagactcccttggactgcaaagagatccaatcagtccatcctaaaggaaatcagtcctgaatattcattggaaggactgatgctgaagctgaaactccaatcctttggccacccgatgcgaagagctgactcatttgaaaagaccctgatgctgcgaaagattgagggcaggagaaggggatgacagaggatgagatgattggatggcatcaccaactcaatgggcatgagtctgagtaaactccgggagttggtgatggacagggagcgctggcatgctgcagtccatggcgtcgcagagtcggacatgactgagcaactgaactgaacttttcgtgaaaaaaaacaacaacaacaacaaaagtgtggtattttaaaaacgtttttggccttctctttaaaaagtggagttgaggtacttccctggtggtccagcagttaagactgtgcttccaatgaaggggatgtgggtttgacccctggttggggaactaagatcccacatgtggtgtgggcaaaaaaatagcttctaaaaaataaataaataaataataaaaagtaaagttgaattccactctccttgaaggctagactacagtataagacggaaattatagcgtgtgatttctcagttgctgtgctcagtcagtcagtcatggtcagctctttgtgaccccctggactgcagcctgccaggatcctctgtccatgcgattttcccaggcaagaataccagagtgggctgccattcccatctccaggggatcttcctgacccaaggactgaactcgcatctgtttcatctcctgcactggcttctgagacaatgtcataaaaggcttcctctcttggatctgtgctctggggagagccaaatgccatgtgaccaggacactaaagcagcactgtggagagtccaggtgacggacaagtgaacctcttgacagcagacatgagtcaaccacccccacggaagtggatcctccagccccagtcggtccttcagatgagaccacggtcttggccagcatcctggctacaacctcatgaagcagaactacccagcttaagccactctcaagcttctgacacacagaaaccttaaatagtaaatgtttgttgttttaaggtgctaagtcttagagtaatatgttacacagcactcagtaaccaatgcagtgaagatattcacatatatgcttaaatatttgcagaatatctctaaggagaaaactaagagactgggcctcaggggtggaagaaaacattttttatcgtactgtatctttttatatttatgtttttattttcctaatgtattatcttttctttaaaaagatacatttaacaaaagaacttcatagattccatgaatgactgaattgtgcataaatatctttaatctccctattttaactcttaaaaaatttaatttgttccacttgtgaaataaaactgaagtaaatagtaaaatacaagttgaaatattttagaaaatatctccccccaactctgcccagatacagagcctactttataaatcagtactctgtcagaaaaagagcagagaaaattaatgatgaaaaaagagaagcttaagagatttaaatatccacctccctgattctcagagaaaacttttcttggctgaatatcacaggagctcagagaatggttagggcaaaaccagcctattttagaaaatcttgaagaatttgtgctagggattatccaagggtcccactctctgtgtctcctcaaatacaattaagtccataactcttaagggaccctctacatgcaggtcctctgtacatgcttgtatagcccccactcaacaggatcccactgtcccttcctccccaggtgaccattatgtgccagactatagtgccttcatggagaagactgactctggcccttgagcaagggaccctggactgagcagtggggaacagagtttgaatccagcaaggcaccttgaaccaatcatccatccatctgacttatttaccttccattaccaagaagaaatctgagcaccaaagaattgatgcttttgaactgtggtgttgaagaagactctttagagtcccttggactgtaaggagatccaaccagtccatcataaaggaaatcagctctgaatattcattggaaggactgatgctgaagctgaaactccaatacttggccacctgatgcaaagaactgactcattttaaaagaccctgatgctgggaaagattgaatgtgggaagagaaggggatgacagaggatgagatggttgggtggcatcactgactcaatggacataagtttgagtaaactctgggagttggtgatggacagggaagcctggtgtactgtggtctatggggtcacaaagagttggacacgactgagcaactgaactgaaccaagaacagatggagggcctcccacaatccctctgccgtgccaggtggtgaggacatcccatgaatctcactcaagggcatgtgctgtgctgtgtgtgcacgtgtttaagaggttagcaaagcacctctgttcccaccccaactaaccctgtatgatttcacaaacgtaatgtgtaaggagacgacagaggataagatggttgatagcatccattgatgactcaatggacatgagtttgagcaaattctgggagacagtgaaggacaggcaagcctggcgtgctgcagtacatgaggtcccaaagagtcggacacaactgagcgactaaacaatcacaaaatttgtaagcaagtggcatagacactcagaaaataatgacaaaagaaatgtcatttggggggaaaaattaaagttacagaactgcatttttgctcatttcccttttgaacacaaaattcatatttggttatggaaatagcatctccattttaagcttttcggacaccaaaccaaagaggtctcggcctgcttgctcctggagaaagatgcacagagtccaccagatgttggtcccaacagacccctttgccactcccaacccccattcaatgtgacaatgttaggacaactcagttaatttacttatctatttaggggggcagcatctcttgtagacaatgcttattcaaaggccatgacttgagttctactttgttgcactcagtttcacctcccgggagaatctaaatataatggcaaatacaagtttccgagctcagcagtagctgtgtattagtggttaaatgtatggtgtccaaaacatagtttaagaaattcttagattctggtccaggattagtcacttgtcatgtacattaaggtttttttaattaagtcaggtgaaatctgctaggaaatccattttttagactatcccacccctgctgcatgtgtgctcagtcatgtccgacactttgagatcccatggactgtagcctgtcaggctcctctgtccatgggattctccaggcaagaataccggagtgggttgccgtttccttctccaggggatcttcccaacccagggatcgaacccgtatctcctgcattggcaggcagatctttcatcaatgtgccacctgggaagacctatcccacccctggaccctgcctgaaagtattagaagaaccaaacctgtgagcaagacttccttagctactaaatccttgtgtctaaagtccttactttactccatggtgttagtatcttgtttgtcatttgttcttggtgtgttattatgttgtcatcctttcctttgtaacgaagagatgaatttttgtttctaaagacattgccagggttaccctataatttgataaataattatcacttctttgagaaaacaaaactaaaaattacatgatcagcaattcatttaccacacaataattcaaggaggctttccagtggcctgctttatacattcatggctcttttacaaccaagaatacattcttgcataggtacagaataaaataaaatgacaaagtaatagaatgacaattcttaccaagataggtaatataaactaccaggtgactaaatttagaagcacatcttattattacatttcactgtgtcatatgtcattactttctgataaccaatacatttgtcacctatacattttaaaaataggaataaatataaaaaatttcccaaatagaatgagacctaattaacttaaaactttgtttaaaagaaaaaaaaaaactgtgtttactaggctgtcatgaaggctaggtgaatggttagaggaacattgtagtattatccttaaagaacagctctgtgaaatttacactccagtcatggcatcaaaaacccaccaagacacactggcccctgacatgtttacaaaacctagatggtcagatgtccactatggaatacagcatccagataaagtacagcccaaataaggagcttgctaagctgctaagtcacttcagtcgagtccgactctgtgcgaccccatagacggcagcccaccaggctcccccgtccctgggattctccaggcaagaacactggagtgggttgccatttccttctccaatgtatgaaagtgaaaagtgaaagtgaagtcgctcagtcgtgtccgactctcagcgaccccatggactgcagcctaccaggctcctccatccatgggattttccaggcaagagtactggagtggggtgccattgcagttatatttggcaaagaaatcctattctgaactaatttaaggattctaaatcaagtatcacaaagtcaagagataaaacaggctaaagggcttttgcttgagttttgctttgggattcttttgtttttcaggacaatgattattagaagcaagagaagaaagtgagatgccttaacaatcctatgggacacatcccaagagacccttagaagctgcctcaggcagtagttgcttcaaaaccagtttcactgtttggaggtccatttgttactttaacaaaaggaaaaggactgagcaccctgccaatcatcagagtcaaacattctggctaagccactcaggacacgcccccttgcctctgcctacccacactacgctaagcagaatctgagaaaacaacttgtttttacttttcataatattcttctcccccagagaatggaagtaattgggtatctagaggtattttccctaaaataaaataaaatggcagggatgggatggaaaagggactatccccatgcaaaaatcaatgaaagttgatcagaactagcagatgtaacaagaattcacacttataccaggcttctttcaagtcaggtactgttctaagtagaatcttatcttgaatcccagcaacctcatagagtaagtactattgttgttcctgttttatccataagcaacgaaggcacaaaaaggctaagtaacttgcccaaggtcacacagcaagaaagaaaaaaagccaggatttggccccagctcactggctctaaaatctgtgctactgatcattacaatataccacctcctacaggcagccaccggttcacacacaccatgcatttccagacctgtgctccacactggagacagcgtacagagggtggtgtgagtggagttttgacagggggtacccaagccaaatcagggttgggaaagcctccccggaggagacgatggccacgctgaaccttggacacaagcagataaccaggcaagggagggtgagagggatgaaggggaagaaacttgattcgggtagagcacatggaaaatttcaaggcagaaaagaatgtggttctcccaaggaccagtaagtagtttaatttggcggcacagtggtatcaagaggtgggggtgagggggcacccaggcaatgccaaggagacaggaatcacatcccagagagcctcgtgatctggctaaggagtggggatttatctgccataaacaactgaggaattttatactaggaaacaaaatgatcagatcttttcttccttagctcactggctatgacgaaggactagactggagaaaaccaaggatggaagcagagtccagttaggaaactgtttccaagctgtaatgagagactggtatcctatagtccagaaaccagagccagggggaaatttcttaaaccaaggagcggagctggaacacgcacagcagtgccgtgttcaggttccccctcccttaactcccctgaagtcttcgtgctccagggaccctccttggggtttgtaccctcagattatgtcccaatacatgatctgaaaagtcttagcatcttaaaaattgccccgaacaacacaatgaataaaagcaagcccatccttcccaaattctcttgccactcaaagagttcttgaaattctgatcttaatcatgttgggaacttttttttcccttatttcctttttttttccagttattaaaatttgcttacatttctctcaaggaggttgggtcataactggcctctataagcctggaaatattttgcaaggattatgatttaacatacaatgcacattcttgaccttattatctgctgctttcctggtctggccaaaggtctttgggaagagctttttcaacaaaaaacctgctcctggaccttggtccttatttgtgatgccttataggaatccctatttaaactcaaaactacctcacttgtatctctacagaatctttgtcctctttgactctttgaagtaaggctgaaaataagacaaagaagcaaacaatggttatcagcatattgcatgcctcttaaaaaaaatgctaaaatgttccataaatattaccatatttaaataaacttccattttcctcccaaacatacgttattgattctcccaaaacgaaagaggttttgggagttgaaaatttgggccaggtctgggcctctgagatttgagtcctagtatacagtttcactttacaacctatctgttagcattttttcactttaagtattagcgtttcctttggcagaaattgttcggaacatcaatagggcttgtcggggttttgcttttgttctgtaggttctttgagaacctccagactagaagggccagttaggattttcaggacaaaggccggtggaatgctgaacctacctcccaccatccccatcccaacctctttgtttccaaaccctcaattcttccccgtcacattcctttggatttccccgactcggtggggaaaaaaattccgcctgccaaagcaggagacgtgggttggatccctgggtggggaagatcacctggagaaggcaatagcaacccactccaggagtcttccctgggacatcccatggacagaggaccctggagggctattgtccatggggtcgcaaagactcggacacaactgagcgacttaacaaccacgctcctttaactcttctccttgaaacgcaggctgtcctgcctggctcccgcggacagagggctcggtgaccattgggcgccgagagcatgatccctgagcgtccctctgggatcagatctgaaaagacacgactgagggtgctgggagggggcgtcccgggagttgcgggaagccaggtttaccttaacgaagagggtgatgtcgtggtcctgccccggggccccctcctcggacgcctcgccgccctcctggccgccgttctctggcactatcccgccgccgcgttcagcgctgcgctcgtccgccaggtggttgctcaggtcggcctggggctccccgacctccgccggctggatcgcctctccagccgcggtgccgtcgggggactcctcctcgcccccggccgtggcctcctcgcctggcccctggagaccctgctccggcctctcctcttcggcctcctcctcctgccccgagggcccatcctggtccgcttcctcactggcctctgccctcgcgtcccctggggccgcttcccccgcctcttctccctcggggtcgcccgtctcctccgctgagccccgaggcccccgcgcaagctccccgggggtgcactccgcgctctccggcgctggggcctcaatcgcctctgcctgggactgggatttgctgtcccctccgtcccgggactcaccctcggagccctgcgctcctgccgtcggcaccccgacatccgtactggcccccgttggccccccgacatctgtgctatccgccatcgattcctcggctcccacactctcccccgccggcccctctgcgtccacgcgggcccccaccgacccctcggagtccacgctgttccccaccgactccggggcgtccacgagggcccccatcgacccctcggctaccacgctttcccccaccgactccggggcgtccacgcgcgccccggacgccccaggcgcgctgccggccggctcccccggcccgttccccgcctcttccttcgcgttcaaggcagcgggatccctgggccccgcctgaacctcccccggctcctcgccctgcgcgcctggcccggggctcgcctcctcctccggctccgcgccgctcgtcggcccctctccctcgcgggcgtcctcccctgcctcggcctggccctgcgccccgctcccgccccgcgtctcggctcctgggcccccgccagagccaggttccagcccgcccgctcgccctccggccggtcccgggccttctccctcgggccccgcggccgtcgcggctgcgcccgccccttcgccccccggcgcctccgcggggccctctctagcctcctctcgctgagccttcgggccggcggcctccggctcgtcccgcctctccgcctgaagcgccgggcccccggacgggctccgaggacgcggggcgcccccgtccagctccgcgaccccggccatggccgtagatccctgtcttgaaccggagacccttcctggactctgctgaggagccggttggcgctaggcgaagggcacggcgcgggggaccgttgcaccccctcggagaggacacccctgctccgggctccggcggcgcctgagcggtgcgctgggcgcgcggggcgaaatcctctagtcagaagacgccgcgccccttcccccgggcttaagctctctgggttctttcaccgctcctgtttctccctggttccgcgtctgcttcccacctgtacccctaattccgaccttggttccctggaatggcgcccgcgggggtgcggtgcgcggctggggagggccgcttagcgcctgcacccgtggaggtgcctggctcggcgttcggaggttgaccaggagtgcccggtgccacctccatccccgctggggcttgggcggggtttgcatccccctcggttccccctacgtgggtggcctgagagcctggccaatgacagcctttcttgcggcccttgtggatttcagtgaaaagatcctgatcctgccggcagcttgggagctttctggaacagcttcaagttccagagccattaaaatcacccccagacgcccaaatacctaatccccactttcccaggagtcaagtgttaaacttcagcagctgcgcaactgcaggtgcccctgaaatgcctcagtgcctacgagtcacgtagatacatcctggaagaaggaaggcaaggcagcaccctttccttctgatttctgcagggccctactgagaagttccagaggccccgatatagaaggagaggagctgtatcatgtaatctatcgtataattctgcatctttctttgattttctgtaatttaaaatgcattatttctagctctggtggttcagatggtaaagaatctgcatggaatgtgagacaccagggtttgatccctgggttgggaagattcccctggagaaggaaatggcaatccactctagtgttcttgcctagagaataccatggaccaagaacctggcgggctacagtccatggggttgcaaagagtctgagcgcgactaaaacacacattttacaatgaatacaggctcaatgctgaaaatagggtagctagaaaataacagctcttgaaaaattttctgtaatctcattacccatgttaaatgaagatatctcatgccatgtcagtaaacaagaaatgtcacagccatcagtgacttctggcctccaaatgtgattgagggttcccaaaactgcaatccaggggatgccaccacactccatggtgactgctgaggagctgggggaattacaaaaagcagccatctacctctgtttaaggagaaggaaactggatttggccccagatagttgaggtgcatatgaaaggaatgaattctgtaagcccagaggcttgcatcttcccagacttagaatgctaaattcctgaagttgatacctgatctttgatgctcagactgcctagtccctttgttaaacttgttcatagcctgacttcccctccggcctccttggagcagtctctcagatttaagtaaggtgctgtctccagggctgcagtcttccctttgccccaaataaaactgaactcacaagtctcaagttatacatattttttagtcgacaataaacactttattttagagagaaataaggaggtggggtggcctgggggctgggtgctaggaggccagagcaagactttgagtatacagcagtgaacaagactgagaagtttcctcccattatcagagctttgaggtggaacaacagcaacaaaaaataatcaaaccagatacctttggagttttatatagacatatatactggaatagggctttcctggtggctcagacggtcaagaatccgcctgcagtgctggagacttgggttcagtccctgggttgggaagatcccctgaagaagggaatggcaacccactccagtgttcttgcctggagaatctcatggacagaggagtctggcggccacagtccatggggtcacatagagttggacacgactgagcgactaagcacacacaaacacatgaacatatagaaaaccttagctcctgtatctcacacccccatatccaacctgccaggaaatcctattatctgtttttttgtttttttttttaagtatatccagaatgcaacctcttctctctaccctcattgctaccagactggtccaagcagccatcacctcctaactggttctcctgcttttccctcacccttgtataggctgttctccacagtcagttgatcctcatttgaaatcaccagtccaccatgccacttttatgcttgaaacctttcaaagacttcctgtctcatgtcaagaaaaagccaagtccttacacatcaagtatgagattccataaaaccaggcaccttaatctcttctggcctcaccggcttctaacacaccaacctctctgctatttcctggaacttgccgggcaaccctctgccagggatgctccccgtatcctcagtgatcactctttacctttggagatctttcacaagctcttttctcaaagcacttattttactttatgttttaattttatttttatgggaataatccttaagacctaccctcttagcaatatacaatattgttcaccatcgtcacattgttgtacattaaatcttcagaacttactcatcttttgcataagtgaaacgtggtacccgtgaccaacacctttccaattccccctcgccccactccctgacaaccaccattctattctctttctatgactattttagattctacctatcagtgagctgatgcagtacttgattttgtttttccagcttatcttacttagcataaggccctccaggtttatccaaattgttacaaacggcaggattttcctcttttttttttttttaataagactgaataacatcccattgtctgtatctaccatatttgctttatccattcacccacggaagaacattcagattgtttccatatcttgaccattgtaagtaaagctgcagtgaacaaggataagtctattttcaaacacagcctctactctcagtcgcccttttctgccttgtttttctccatagcagttatctccttgtgacataaggtattctacttactcattatctgtctccttcatcccaccccaccgggatggtggttctgtgaagctgggcacataataggcactcagtaagtaaatgctgaattagtgaatgcaggcatgctttcatatacatcaacctgtatacaaacacatacacacacatatatataattttttttggtcatgccacatggcatttgggatcttagttccctgaccagggatgaaacctctgccccttgcattcgaagcgcagagtcttaacccctggagtgccaaggaagtccccaatctgagccagttttcaaatacacttttttcagttggttttatactttgggggataagctaatgtcatgagacaggctatacacagaaaatcttatctactgactttggtgagtacttcagtaaatacttttaattactagcaaaggtcaatcagttggtataaaggaacacaaaggaaatgccaaataaatcgagctgtgaaggtcactgtgaagtcacttagagatttgtgcagtgttgactctgttggccagcaccagattagctatttaaataccaaggagggttaaacagaggtgaggaattcagggatgggagggaaaaggcaaaagtgctgataattaagtcgatttttagtaattttagagttttcctaccatcttttatgaggaaacacgaagcagggtaactcagggattacaaaaacaatctcaagggcttataaataaataatataaaggtttgttgtttttactgttttctcagaacgagcagactcatttccacagagaccctctctttctccagcaggtctctgctcctttcagaagagcccttgggaagatggtgtatctagaacattcaggccacaggctacactgtggccaaacaagacgtcccccttgggttgatttctcctcaaagacctcctcctcctcacctaagaatggccccaagcctggctgtgctccatcacttagataggtatatttcagtttgttgctgtcgttagtcactcagtcgtgtccgactctgcgagatcccatggactgtagtccgccaggctcatctgtccgtgggattctccaggcaagaagcctggagtgggttgccatttccttctcctacttcagtttagagaagggtatctcaggatatccctggtaatctagtggttaagactccacacttccactgtgacaggctggattcaagcctgatcaagtcatgtggcccagccaaaaaaacaaaaaaaggaaggatattgccaccaaatcatcctcacctaggaggcaggaatttaagcacaggtagagcatcctgtaagccagtgaaaacatcacacaaaccaacacgaattgtgtcacgtgaaacaggtagtttctctgatcactttgcctgacttaaatcccaccttatcacatgttaactgtgtgatcttgaggatgtttttcatctagaacagtgggcataagaggattattgtcattgtgagcttcgaatcagaggatgtatgtgtgatactcagcacagcactgattcttgtaaacactacaatttccttgttgtacttgtctcaggagatagagctgtcacatctggacagaacggtgtattacagggcaagaagagccatggaaaactaggatgacacttcatcccacttagcctgtgatggtccaggttatgtctgctctttccaccaagacgatgagaggattccccccaccccccacacaggaagtgtcttggtttgagggcttccctggtggctcagacagcaaagaatccacctgcagtgcgggagactggggtttgatctctgggtcaggaagatcccctggagaagggaatggcaacccactccagtattcttgcctggagaatttcatggacagggagcctggcaggctacagtccttgggtcacaaagagtcagacaagactgagcagctaacacttttgactttcaccctgaacttttctaactgctgggagtttcctctgttttctttccatgtgattttgcactatttttaaaacaaactagattctgagcaaatacttattggatgatataaaagattttaaaaagggagaagaggaggtaggagaagcaaaggaagaaggggagggagaggagggggaagcactccaatttttattacaaaccacctgctgaaagtcttgctgcaaagttagttcataacctggaaggatgattggtagaaacacgttcagcccagcggggagggcaggggagaaaaggtacagaaaccttctgctgagctagcttctgggtcctggtgactgtagtttgaacctctcattctcgtcacctttacttctaacaccagaaggagcagtaacaatcttggtggagatggaaatagtactagaatttaagaacaaaagtcagttcaaaatctcccacctctatctgtacagtttctcttagcattttggtcgatcactcagagcttttgtgtaataaagttttattaaagtataaaggagatagagaaagcttccgacataggcatcagaaggaggcagaaagagtacccccctgctagtcttcagctggatattatatagtcactagcagtctgtcagagaaagaaaggaatgtcttaaaactcagaatggcaccaggcccctcacccataagatgcattttggggtaatcttggcaccagatgattcatcccgggccataaaacgattggcttgaatcttgtagaagggcagattactatacaaatagttttgtttacataggttaggggaacaatgtctgagtgtaacatactggtttgtcaagtaggttctgagccattaggcagaaccgacttgaagacagagtctggggtaaatgcatagtatattaacatagcttaaaacaaacatttccataagaaaaatgcattggttaactcaaggtttgagaatagttaacttaaggtgaaaccaggtgtcattatggcaacacagtattttaagagaaaccttcttttaaatttgtatagagaaggaaaaaatatagctagtttgtttcctcctgccacttaagagagataaaaatgtctgacacttgcaggctatttcctccatttggagacccctggccttcctgcctgttaccctctcagtgggtcgggaagatccgctggagaaggattaggctacccactccagtattcttgggcttccctggtggctcagctggtaaagaatccacctgcaatgtgggagacctggattcgatccctgggtttgggaagatctaccaatcctgcatgctggcctggagaattccatggactaaagagttggacaggactgagcaagtaacatacacacccgcaatcacattctatttcggggttataatagagccactttcacttttcactcttttagaaacttgagtttcttttaactctttcgaaccctgcgtttgtgatctcctgtctccagaacttcagaaccctgtaatcaatggtgacggatgtgatctgaagaaacagagcttgatcttgatcactgagttttaactgggggcagttttgtcgtgggacatttgataatgtctgggacacatttttttggttgtcgtagataggagggtgctactggcttctagtgggtagagcatcaggtattgataaggtttactcctttatttcaaatgagccaagaaaatgacttattcgttgaaagaaggaaaagagagaggaaggaaggacagagaaaaagaaagggaaataggaaggaaggaagaaaagaaagagcctctatatgtgtggcacacaacaagcaaaaatcttaaaagcaaactggtgactgtgaatattgggaggaaaacaacaaaaatattttgctttattttattacatttacttatgaattagcacaataatattgaggcaaagccccatatgtgaatatttcaggcggaataatttaatacaaatgaattatatataactatttattatatattacaactacccatattgcaaataaggcacatgtgtgtgccatgtctgactgtttgtgaccccatggactgtagcctgccagcctcctctgtccatggaattctccaggcaagaatactggagtggttagccattcccttctcaaggggagcttcctgagccagggatcgaacccaggtttccagcattgcaagtagattctttactgtctcatccaccagagaagcccatataaggcataactgcatcaactagaaatttatgtggtcctataatttctcttctttatactttctttattgaagcctaaagtaggtttcaattctttcataatttttttttcctggtgtggtttccagaaatagtattaaagttcttgttcatttaaagttagttttgcaggaatggcagggaactgactccttgtcagtggagttaaacagaaaaaacgcaatgaatagatcccagcgctgaaggtgctggaggggaagaggccccctgtccccagggatagcacttaaacttttgcctgccactttccaggcaggtgtgttctaatggccaagcacatgctatatgtataacaagcgcacagtaaagatctcacacccgcttagaacacaaatcttgaaaagaccttaaagagtactccatctagctccctcttgtagatagaatgttttgcattttgccactataaagttcttacacacaggtattatttttaaatcatttaatgttctctttaatcctgggaggtggtcactgccctgcagcaaaagtgggggatgccatagagtgaaacagcatggaattgaactggattcagcgtattaaaaagcagaggcatcactttcccgacaaaggtccatctagtcaaagctgtgctttttccagtagtcatgtgagaactggacaataaagaagactgtgcgccaaagtgttaagggaagcacactgattgaatctgcccaccctggccaggcaccataataaccatttgcatgagttgttttatgacaggagatcctgataaggaatatggaactaataagccgccaccaaccagaagagttcggaaaaggtcgaaaggagactccgtgtccatccacttcccagaatgcctctcgctagcatccatcttggctgagcgatgcgtgcgccaccaggaaagactctgaattagaatgattggccagagaccacccggaaaggaatcccatcaccataaaacctgagactgcaagccatgtggcagagctgttctcctgggttcccttaccctactgctctccaccagggtgccctttcccagtaaaatctcttgctttgtcagcacacgtgtctcctcagacaattcatttccgagtgttagacaagagcccagtttcgggccctggaaggggtccccctccctgcaacaaaaggattgatgcttttgaactgtggtgctagagaagactcttgagaatcccttggactgcaaggagatcaaaccagttaatcctaaaggaaaccaaccctgaatatatattggagggactaatgctgaagctgaagttctaatactttggctacctgatgcaaaggagtgactcattggaaaagaccctgatgctgggaaagattgaaggcaagagaagaaggggacgacagaggatgagatggttggatgccaccactgactcaatggacataaatctgagcaaaatctgggagacagtgaaggacaggaaagcctggcatgctgcagtccatggagttgcaaagattcagacaggactaggcgactgaacaacaacaataaattgagttgtgaaaaactcttttaacatgattttttcctgaaatatttcccatgaagacagcttgatcacttttggaccttatgataaaatgcttatagtaataatctctgacaatcatgaaataagttttcatgctccacttccttccctattttattgagtatgattgacatataacaacatgtaactttcaggtgttcagttacgatgatctggaacacatgcacattgcaaaatgattacaaggaagttacttaatcctgctatcctctcatataatttccattttgggtatgttgggaatatttaggatctactcccttgggaactttcaagtataacaatccggttttgttcattatagtcaccacattgtacattagccctgaggaacactttcatcttgtaactgaaaaccagtaccctttgaccaacttctccctgtttccttcaccccagcccatgacagccaccatcctactgtttctatgagcttacttttttggattccatatagaagttactgggctccacttttacgtagaactctatcctggaagcctggctccctctgtgcaggaggctggctttgggtcacagcctccatcacccaggttcaccttgatggctacagccccagtcccacccccacccctgccatcttcccaatactgctgctaaattttgttctcctttaaattggcttttcttttgttgttatttttttcttcttaaaaacagggtcaactggtagccccagaatctgaggccctgttcttcaagcttggtaacagttgccccacgcagagcagtgatgagaggctccagggttttccccactccccatactgcagcactaaaaacaacaaaaaaatgctgtggaaagatgcccatgccagaggtgttcctggcaggagaatttgaaaaccaagggatgtgaaggtctccgtggtgtctgcactctttacctgtcagaaaagcagcaggtggggttctggggaacactgactctggtgtgtgatctggctgccttcttaccagctgtataacttggggcaactcacttcacccctctgtgccttggactcatcttcccaccccacaagagggatgttatgagtcaatgggtataaaatatagtcaacttcgttcttcgaagtttcgaagacttgataaaaaatctttttatttctgtacacttacagtcccacttacattgtaattatttgtaaccccaaatcaacacacgctagtggggttttaaaacatttttatttatttaatttttggctgcactgggtctttgttgctacctgcgagctttcacgatagttctataaagttgccatgaatactgaattaggaaatacagaacagctatgggcgggtgctactctttgttgtggggcagaggctccaggaatgtgggctcaggagttgtggcacgtgggcttagttgccccatggcatatgggatcttcctggaccagggttcgaacccgtgtcccctgcattggcaagacaatccttaaccactggaccaccaggggatttcattccacagggcttttgtggtcatcctcagatatatacatagggcagcaaaaaattagtcgcccaatgtacatgtttccaactgaggttgtataaggctatgactctgccttcttattccaagtctcatgctataaacaagtgtccttttgatagtctattcaacgccaaggtttttgtgctttttgttgattttactgttcaaaatgcacccaagtacagtgctgacctaccgtctagtgttcctttgcacaagaaggttcagatgtgctagagaaaatacatgtgttaagatttgttgaggcacaatatatatgaaataatgtctttggtagctcagacagtaaagaatctgcctgcaatgtgggaggcttgggttcaatccctgggtcgggaagatcccctggaggagggcatggcaacccactccagtactcttgcctggagaatccccatagacaaaggagcctggcaggctctggggttgcaacgagttggatatgactgagtgactaagcacacacagagaaagaaacacacttaaaacaaggttatttatttgattagcctatgaaaaagttgtgaccaaagacttgtaggaactatggcatctggtcctatcacttcatggcaaatagatgggaaaacagtggaaacagtgagaggctttattttggggggccccaaaatcactgcagatggtgactgcagccatgaaattaaaagatgcttgctccttggaagaatagttatgaccaacctagaaagcatatttaaacgcagagacattactttgccaacaaaggtccatctagtcaaagctatagtttttccagtagtcaggcatggatgtgagagttggactataaagaaagctgagcactgaataattgatgcttttgaactgtggtgttggagaagactcttgagagtcccttggacagcaagaagatccaaccagtccatcctaaaggaaatcagtcctgaatattcattggaaggactgatgctgaagctgaaactcaaatactttggccacctgattcgaagaactgactcactggaaaagaccctgatgctgggaaagattgaaggtgggaggagaaggggacggcagaagataagatggttggatggcatcactgacccaatggacgtgagtttgagtaagctccgggagttggtgatggacaaggaggcctggagtgctgcagtccatggggtcacaaagagttgaacacgactgagcgactgaactgatctgaactgaactcaaccctgtatttctccagtgttagttgttctgtattttctaattcagtattcatggaaaccttatagaactatcatgaaaagtaagaatcagctatacttagaaggatacctgacatagcgtaatgccctgggagtatcaccatttaatccttattatttgtaaactaatacttgtaaattaattgtaaataattcaaaattattgttgttgtttagtcactaagtcatgtccaactcccaagaccccatggatggtagcccaccagagtcctctgtctatgggatctcccaggcaagaatactacagtaagttgccagttccttctccaggggatattcttgacccagggatcaaacctgcatctcctgcattgcaggaggattctttactgccaagccagtggggaagacctaaaaattgattgttatttgtaaattcttgtagtcagtgttactgggttaacagagattgtctgctgtaaaaaccccatagaaatgtactgtctacacatcatctaaaggttgccttgattcactttcatcatgtagggaatggcgccacctccatctctatcctggagcactgcagtagcatcctgactcttccccctcatccccttggatagattctcaatttggcaatttaagtcatctttttaaaaaatgttagctgaataataccactcccttcaaatccttccactggcttcactttacacctagaacagatctgaagctcttctggaaactctgacggtgtatgtacagtcatctccactccttctccaacctccgtctcctgcctcgccacacgaatctaaaccaggacccccacatgaaactctctgccttcaactcacatagctcacactctgacttcggtaaggtccctgctgaagtcacctcctcaagcccatctcccctgattgtcctgtgcaaaacagcttcactcccctcccttcttctccatcctcttcctcagctctgttctatttgtctgatttctgtccggccctccccccccaagacaggaagctccaggagggcaaggagcctgcctcttgttccttagtgtttcatcagcacccagaatggcgcctggagtccaggacgatcttgatcatcctgtgttaggtgaacgaatgctactttgactgaattgacttgacttgctatccaagttgactggatggttttggactgtttgcacagccagggctttttctaggggaataaatgtcctactcagtcagccagccatcagatatgttttttaatagatttttagaaaaatttattttgttgcacaggatcttagttgtagcacgcaggatctcagatcttggcacacgggatcttcaacctttgttgtgctgagggcactcttagtcgcgtcaagtaggttttagtttcccaaccagggatggaactcaagcctcctgaagtgggacctcaagtgtggagtcttagtcgctggacctccagggaagtccctcaaacatggtttacttggcagagttactctgtagttcctgctcaggttcagttcagttcagttcagttcagtcgctcagtcgtgtccgactctttgtgaccccatgaactgcagcacgccaggcctccctgtccatcaccaactcccggagttcactcagatccatgtccatcgagtcagtgatgccatccagccatctcatcctctgtcgtccccttctcctcctgcccccaatccctcccagcatcagagtcttttccaatgagtcaactcttcgcatgaggtggccaaagtgctggagtttcaggtagaggtgaattagtaacttggtgaactgtctataaagtcaagattgaaatgtaaccacctcatttttcttcccacagactcatttgcctcattaaaaggaagccaagtgtcttcctcttgagaccatctgcttcttttgatttgcccagaaccccagacatttcttcttgccaacagggggcaaaagcatctccggtttcccaccttcacccggtgctgatggtcaagccagaggcccttctcctctcttcagggaggcctcatcccagttcccacacagccccaggggctaaagcttggagaggagacaactccaagaccccgagttctcccggatgagttcgtacatcccagctcacagctagtccccaacaggttcacccccagcgggtttcactcccagctcccatccggggagcttcccaagttgcccccaagagcctgaggttgggacactgttcagttccaccctgcctcgctagtgtgggtaacttcttctttagcctcaaaacagaaacatgccaactctactccttccctggtaacccagggcaaccccgcctgcacctggcttttgatgagtcaaaaacaattgaccagactgaccagccctatgtcttctgacaggtagatggtggcttctctcaccaagaaaaataaaataagcacactttaatttccattgtgacacccctctggaaggctcccaaccacatttgtaaatgaaaacttaaaaaaaaaaaaaaaccctccatttcagagtagcctggtggctcagtggtaaagtatccaccttacagtgcaggggacccgggttcaatccctggtcccagaagattccacatgtagctgcaactaacactaaatacagtcaaattaaaaaaaaaaaaaaaactccgtttcatacttacatccctgatttcacagatgccactcatgacgtttatgaatatagaggactgacttcaataaaattttaaaacaagccaaggggaggtccagcccttccatcagtctcttttccttgcccttggtgtctgggtgtctttggatatgtcccctaacactttcagtccttggtttcccaagctgtacttttgggaagtgatccctgtcctgttcttacaagggtatctaaggactgaacaaggcgtctgtgtgaatggaacccataaaccgtggacacacaaaggtaatgcatcttcattagaccttcagtccatgaaggcagtggagtcggaccccagcgtgcatcagaatgacaggggagaactccaggagacagtggaggacagaggggcctggtgtgctatagtccacggggctgcaaagagtcggacatgacacagggactgaacaacaacaagttctatctccagaaaggattttttatgtccatcagacttgaagtcctggtgtctgttccatagatgctgaagggatatctcatgctcttccaggtttcgaaagatccaggctcaaagatcaagcatcatactttcattggaacttggatcaatgagataccactccaaagaatatttgtacatgaagtcctaactctatttgagaaataaaagctttatgctcattgtcattttgtctatacccacaactcagtgagacagctattttttcaggtagttccctgaaattaacctaggtgggacttttgtcaaaagaatataatgttatatttgaaccagatatcttttcattggtttcattactattttattttatttattttgctatacaataggtccttgttgttaatccattttaaatacagcagtgtgcacatgtccctcccaaactccctaactatcccttcccctcatccttccccctggcaactataaattcattctcaaagtctgtgagtctctgttttataagtaagttcagctgtatcatttctttttatacctggtggctcagtggtaaagaatctgccagcactgtaagagatctgggttcaatccctggatggggaagatcccctggagaagggaatggctacccactccagtattcttgcctgggaaatccaatagacagaggagcctggagggctacagtccatgggatagcaaagagactgacaggactgagaactaacaacactctctgttttacaaatacgttcatttgtatcatttctttttatattccacatataaaggaagtaagtcagacagtgaaagaaaaataaagaatcatatgtgttttcatagtgaaggagcagtaaggaaattggtaggtctaaaaacaatttgggcacacagtagcaagggggaaagtcctatttttattaatggaagtgtgacgaaaagactccaaagcaaacttatttggagattttttaaatatatagattttttctccttataaatctaattgatttttaaggcattactggtctgtatgtctctggtgcacttatatccactccatttgaaaataaatcctgttgggtgagtgtagaaatcatattacatttgatatatgtaaaaacttgaaagctcttttgtaagcctgtcttcaaaccaggaagttgaattttcccagaatcaaactggctcatgtttcaacagaaactcagagcttgcaaaatactggctgtatttttctattcctggctaagacttttcttgccctttccccccctcctttcactctaagtgtgtcacgttgctataaattaaggtggtagttctcctaggttgggataaagccagacatttcacctgactgaggactttgggggctttgttcaagtttctgccacgggatttgaaggcataattgttagatggctggaagtaagctgagaagtttctgaagtcacaggaaaagaccaaggatcacatacctgctggaaataggcaggttatgcactaattaacagctgtgagtcagcagagaaaaagacctggatctatcttggtggatgtgaaagttggcaaaaatgagttcccacctacccttttaacctaggtgggactaggtgtcagcaacaaaattgagttggatgaatggtctaattacagcatgggaccttactaagtggctcagtggtaaagaatccacctgccaatgcaggagatgagggttcagtatttgggttgggaagatctcctggagaaagaaatggctacccactccagtgggaaaatcctatggacaaaggagcttagcacagttgtgggttcgcaaagagtcagacacaactgaccacatacatgtgcacgcacgctcgcacacacacacacacacacacacacacacgcaatccaagtcctcaaagatggagttcaagagattcctggggaaaattcctatttttatattcatgaaactcagattgaaatttgcatttccttcaattgtgaatgagggggaaatggtaatgattgtatctgtgactgtgtccccagttaaaatcacaaatatttttacatctcattccagttgtgcatgtgcgagctaagttgcttcagtcgtgtctgactctttgtgaccccatggactgtaaccaccaggctcctctgtccacaggattctccaggcaagagtactggagtggagtactgtgcccccctccacgggatcttcccgactcagggatcaaacttgcgtctcacgtctcctgcagtggcaggcgggttctttaccactagagccaccaggtgtaactgagctcaaagtgtcacatgtgctcctcacaacttcaaactttcagtagttcttagatctgtttctgggctttatttgatgtgtccataaaggaatacagatattacttcattgcttcttaatatttcttcttaatcacatatttctttgtaataattgataactgtatttcagtttgataactggctttctttgataatcctatgcattttattctatatcaatacattaacaacagtattcagagaagagttcgcctgaccagcgaagggatccatagctcagtaatggttaagaacccttgaattagaatttatttcacatgaaacctatacatcctaaaatgttcttattcttgaattctcttcaacagggatatgagttacacaggtgtatttaatttgtcaaaattatagtgaatgaaaacaacttaaatgtgctttaactagggaatggataaagaaactggtgtgtacatgcttagtcgtgtctgactcttttgcaaccccgtggattgtagcccctccaggctcctctgtccgtggaattctccaggcaagaatactggagtgggttgccatgccctcctccaggggatcttcccgacccggggaacaaacctgggtctcctgcactgcaggcagattctttaccatctgagccacctgggaaaccccaaagaaactagtacatgcatacaatggaatacttccgaagctactgaaataagctactgaaacatgcagcaacatggatgaatctcgaatgcatggtgaaatttggaaaagccaaacttaaaaaggccacagactccgtgattccatttacatgacactatgtccaagtcaaaaacagacaaacacaaaacagattagtggttggctaagggtagggaacagagtctagaactgctgacaaagggcacaggagattttcaagggctgatggaatttttgtaattcaatgcatgttaatttacctgcaattaatagtgctgcaaatataacctaaagctagtttcatgaatatcctctatcttccaactccccccaaagaggtgggtggctggataccccataagcacagagtgcaagccagcatctcttcctctgtctctgccccagttgcacatggtcccttctggctctgagtgcctgtgtctgtcccacgtccatcccatttctacctgctgctttcccatcatttcctcatctcagcccagcctctttcccttggttttttcaaacatagcaactcacagaaagtagttggcataactgggacataatttatagcccaaacttggatacttttgaaaacgaagtttttatgctatggctacaggtatatggctccttggaagaaaagttacgaccaccctagacagcatattaaaaagcagagacattactttgccaacaaaggtccatctagtcaaagctatggtttttccaatagtcatgtatggatgtgagagttggactataaagaaagctgagcaccaaagaattgatgcttttgagctgtggtgttggaaaagactcttgagtcccttggactgcaaggagatccaactgatccatcctaaaggtaatcagtcctgaatattcattggaaggactgatgctgagtctgaaactccactatttggccacctgatgcaaagaactgactcactgggaaagaccctaatgctgggaaagattgagggcaggaggagaaagggaaaacagaggatgagatggttggatggcatcacaaactcaatggacataagtttgagtaagctcgctgcagtccatggggtcacaaagagtcagacgcaactaagcaactaaactgaactgaactgaacaggtataaaccatgagattgtcctggcaatctaactccatggtgtgggagatgtctacttaagatgtacggctcatcatatgcagttggttacatcagaaccacaagaaggaaataaatgacaaaacctgaagattagacatatagattcttaaggcccttagcaattcctggtcccaagaattactcctgtaacaggggttccactctccgtctccaccttaactgctcacacagtgatttagccatcctcctgtttcattcctcacccaatctgcctatgtcctgagagctattgttccaactcaaatggctcatcgggggtgcttttgctaatcagttctctcccctgataggatcatcccatcttctggagaatgaaacagggcagtaacatgaataatgacacgtgaatgagctaaactctgcgggtggcttatctcgctccatcctgtcagagccttatgaggtaactgaaattatgatgcccactttaaagacaggcagattgagattcagggtatcaaataaatctggaaagcaatggagccaatgatccaagccggatccctcagacacgtgggcgaccctggggaccgctacagtgggtcaccgtcagccttgccttgtcccaggtgcctagcacagtggtcaggcaaatatttgctgtctgcctggctgcctgcctgtctgatgtaattgtttaaacaaccaaattaactcaacagttcccaccgcattctcaagctgcttgagctcaaatagtcagtaaaggtcagcgtgagctgatgggctcacaatcgagggtcaagaaaatgctcctgttcttgacttctcctcaagtggagataaccttgttcagaagttcaaagtcatttcccctttagacaccaagacccagacttaacaccacaccaggtgacttctctatgactttacacctgtgaacgtaaaactgaaaatacggatgaagaattcatgctttgtaatattgtaagtcaactacatacagctgtgctgagtcccattggtcatgtctaagtctttgcaaccccatggactgtagctcaccatactcctctgtccatgggattctccaggcaagaatattggagtgggttgtcatttcctgctccaggggatcttcccaaaccagggatcgaacccttgtctcctacatctcctgcattgcaagcagattctttacccaccaagccacctattgtacatcaactacagttcaatttttaaaaaataaagattcagattttggttaactaacccatggcataaatacaaaacattagaaatatcccccaacacagacaggaaatttccatttcaaccaaatgtttgataacaagaaactgctatggttttacataatcagtagccccatcttttctaatggatgtgttgacaagccaaagggaggagttttagaagcatttttctcatggacacattgtgataaatggcaattaggtatccagagacagttcctcctgtgagtccgggggtgggagagctgaacaccagaggaacaagttaagaaagtttcattcttctttcctggaccaaaaactaataggccatccattctcacaaaatgagtgagtttctggaatcctccccacctcttctgcttcctctctgaggtcctagtgtcattcctgacaattccagattcttggtttcctcctttattgacatgaggactccagagcctctacgtctctgcctctatcttcattccaatcagctacatctccttcaaagcaaaatcttatcccccttagtgtgagtgatttctaataagtgttcagaaacactaacagcaagctcttatttagtgctaaccgtctgctgctgctgctggtggtggtgatttacttgctaagtcgtgtctgactcttgcaacacccccatggactgtatccctccaggctcctctgtgcacagaattatccaggcaagaatactggactgggttgccattcccttctccagagggtcttcccaacccagggatcgaacccatggttctcctgcattgtgggccgattctttaccccctgagccaccagggaagctccatattaactcatagcagtagtagtagtcgtatgcattggagaaggaaatggctacccactacagtggtcttgccttgagaatcccagggatgggggaacctggtgggctgctgtctaaggagtcgcacagagnnnnnnnnnnnnnnnnnnnnnnnnnnnnnnnnnnnnnnnnnnnnnnnnnnccattcccttctccagggaatcttcctatccaggaatccaacctgggtttcccacactgcaggcagattctttactgtctgacctaccaggtatatggtgcttataataattcttaagataaatactgttattactaccttgcacaaaagaggaagagactaggagtgtggctccttcagggctaaagctgtgtggctttgtcagccacactagccacactcctgcagccatgaaattaaaagacacttgctccttggaagaaaagttttgaccaacctagacagcatattaaaaaacagagacattatttagccaacaaaggtccatctagtcaagaggaaggaatagagagggtaagtattttgcccaaaggcacccagttggaaagcagcacaactcagcgacgcacctagacagcctggctccagtcagtgaacttaatcctatgaacctgacccttcctaatacttgggaggcatggacctagtgccagtcacctgtatgtattgaggagatacgccctaagacttgccggcgtgccagtcactgtgctggagctggaacacagggctgacaaggccacacagctttagccctgaaggagccacactcctgggaggtcttagactgttagcccagtaatggcaagagcagagtcggggagggaggcagtgaatgttgtattaggagagggcagcccatctaggagcacgtacgagcagtacccgacccttacttggggctgaatagatgtggagtaaggcttggcaaatagttggggaaacaatggaaacagtgacagattttatgtttggggggttccaaaaccactgcagatggtgaatgcagccacgaaattaaaagacgcttgctccttggaaggaaagttatgaccaacctagatagcatattaaaaaacagagacattacttagccaacaaaggtccatctagtcaaaggtatggtttttccagtagtcacgtatggagagttggactataaagaaagttgagcaccgaagaattgatgcttttgagctgtggtgttggagaagactcttgagagtcccttggactgcaaagagatccatccagttcatcctaaaggaaatcagtcctgaatattcattggaaagactgatgctgaagctaaaactccaatactttggcacctgatgtgaagaactgactcattggaaaagaccctgatgccgggaaagattgagggcaggaagaggagatgacagaggatgagttggttggatggcatcaccgactcaatggacatgagtttgagtacgccccgggagttggtgagggacagggaggcctggcatactgcagtccatggggtcacaaagagtcagacacaactgagcgactgaactgaactgaactggaggcttggccaggtgtaagattcaccggaaaaaagaacagaagtttaactggcaaaagcaaagaaaaaaaaaaatgaagagaagagaaaagcaaagggaaaaaagaaaggagggaggtgtcacttgcaggacgtgagtgagtgtgaaggacatggctgaggcccaggggaaggccctggctctcactctctagatctcatgcaactgcttcctggaaagtggagggtccgacctcatgaagtacaggactctgatggcagccccgggctccacagcaaagagtcactgggctggggtgtggttcctgaaaaggaaccacccaactgtagggttgtgactttccaagcagtagttctccactgagggggacatttggccaaatctggaggtattttggttgtgaaagcttaggggagtaccactggcatctagtggatgaaccccaaggggtgctgctagacatcctacaagacacaggacagcaccccaggccagagactgcaaatgtgcccacaatgagaaaccacaggccaaagagatgacccacacaaagcaacccatgagcaattcacaagtgtcccatgggacaaagatggagaaacagggctctctgaagtggctaacttcaataggaaatgaaacaaggcttttaagaaattccaacagtgctttaaaaaaataaagaaaataaaatgttaggaagcccctgtgccaggctctaagtcctgggttcagtttcctaactccctggagtaggtctgcataggggtggggtcacaccctggcccagcccgtgcagactgggtgatcctgcacccaccagggagcctagtctgatatatgagaggctgatccctggatccaggatgaaatgagctgattgtgtgctgaccaatgacggctggtcagcttcagcccttccccacttcccttgctccatgagtctgggatgggagatgaaggcatctgagacggggatctctcatctaactccctttctccctccaggaccagtggtccgcaagagggtagggtgtctatacgccagagacaaaggaataaataaaagcacatattcagagttttttggtattaacactcttaatacctgctttttgtgtatgttttagagtgtaatattttataactaatatataaaatttattagtaaagcaaatatgcaaatatgtggcttatatccagagaaaaaccataatcaaaaacataattgtatcccattgttcttgggctcccctggtgcctcagctggtaaagaatctgtctgcagtgctggagacctgggtttgatccctgggttgggaatatcccctggaggagggcttggcaacccactccagtattctggtctggagaatccccgtggacagaagagtctgatgggttactgtccatggggtcacaaagaatcagaaatggcagaaagacaaatatcgtatgatattgcttatatgtggaatctaaaaaaatgggttcaaatgaacttatttacaaaacagactcacagacttggaaaacaaactatagttaccagagggtaaggggggagaagggataaatttggagattgggattgacatagagaccctactatatataaaacagataactgataaggacctacagtacagcacaggtaattttactcaatactctgaaatcacctatatggaaaataatcttaaaaaaagagtagatatgtggtgaaggacagggaagtctggcctgctgcagttcatggggtcgcagagtcagacacgactgagtgactgattaacaacaaaatgtgtatgtataactgatccacttttctgtacagcagaaactaactcaacgtggcatattaactatactccaataaaaaggaattttttaataaaataaatatgcaaatgcatggctatttttaagttaatatgcttacatgaattaggatattgggagtacaaaagctcataaaatgtttgaggtgcatcatcgaacacttttgctttggctatggtctatttgttagcatggactctgaaatggggtgacttgggaagttgctctttttctttcaatgttttaaaagtttttaaattaattaatttctttttaatttttagccatgccttgtagcacatgggatcttagttccccaaacagggattgaaaccatgctccctgcactggaaggcaattttttttttcttaacctaaacagaacacaaaatttcattcacatggtttcagactccactttgtaacgacctttagaaaaactactttctgtcaaatttgggtttagtgtcaaagaagaatatccacagtaaaaagggtatgaaattattcctcccttctctaactatgtaactgtggtgaggcatgatttccttcataaacctaaacaaaaatagtatagggaggcagattctgaactactggtctgcctgggaaatctttaacattttttttagaccaaaggtttctactctccccagattgaagttcttctcttgggaactttttcagtaaagagggttcgaagcggctgtgcatagaaggtaggtttccaacaatcagcctgggtccgcctccatcacggccttagggactcactctacttcggctggagtctgctcggcagacagtgaggggaaccctgtgcctccaccagtggaagggagcctgggttaaagatgctgtctcctggccagagatggaaaggatcgttagttcatcaagttcttctcttctttgctttcccacattcccagggctggctggtgtctcagtgcaggaaaagtagcaatagacagttactagatgagagcgtcagggtggaagtgagttgtttctctgaatacttgcttggtatggctttgcctagacttcccagtggctcagtagttaaagaacttgcctgcaatgcaggagaccccggaaatatgagttcgattcctgggttgggaagattccctggaggagggcatggcaacctactccagtattctttcctggagaatccgcatggacagaggagcctggcaggctacagtccatagggtcagcaaagagtcggacatgactgagcatgcacgcgtggttttgactattgactcctctatgttcaatttattatgtttaaaattgaaaatattaaaaattattgttgccaattcagagattttaaattagttttttaaaaagagataagcaattcagattgccaaatttctatccctctggactttatttgtaaaagccaggtttctctgaagaccatttttcttttaataaatcggtggcatctttctcaaaatatcacgcaggctgatattccctccctgtgaaatttacacagtgcatgtgctccaaatttcctgtaaaagactcaacctttggctcaatctttccttaagccaaatagtctggtttcagtgaatcttcttttgtttcaggactaacctgtgaaacacatttattctacagggaagcttttaaatgaatcaatcaccggatccctcctgggaagcttctgaatgaatcaatcacctgatccctcctggtacccacaggcggctgagagctcaaggctccctgttttcctccactgttgcctctgtcccttcctacgcctttttagaggccgctggctcattaggaaggtggatcacgtatctgagctgtgtaagccctcctttcaggacacgtttacctgtaaaggggattttggcaggtgatcaactccccaaaggaatttgaagcctctacttgctatccgaagtcccagatcaaggggcccaactccctgatgtggaggggcagcccatggacgcccatatgacgcaccagtctgtatcagacaggcaggcatgcctccaccacacccagataaaaggaatcaaaacccttcccacagtttcagctggctggacctcagctggctgtctttggaggtgatgtgatcgaggaggattcagcgtgctggctggacccatggaaataagcacagaggggacctgatgcagaagggagttcagtgtccagagcaggagagcatctcctttttgtgtaggacctgagggacacataaggtgactaggggacactctagcaccagtatccttccccctgaagacagcatgaactttttttgttgaaataatttcagagtatgatagtttttatgatgctgagactatcagccactaatactggagatatggcattagggcacctttgtaagtacctaaccagggagtagccaaattggcttgttttcatgcctagtaaagacaattcaaagggcttccctggtggctcagtggtagagtctgcctgccaatgcagaagatgtgggttcaatccctgggtcaggaagatcccctggagaaggaaatggcaactcactccagtcctattgcctggagagtcccatggacagaagagtcaggtgggctacagtccatgggatcgccaagagtcggacacgactaaacaacaacaaagacgattcaatggacacgagtttgagcaaactccaggagatagcggaagacccaggagtctggtgtgctgcagtccatgaggtctcaaagaatcagacacaactgagcaactcaacgataacaaccacaacaatttcacagacatgctgaaaaaaacctgtaatggaaactgaaagcttacttccatcgcgtaattttttttttcattaaagggtgtgaaataatacaaaaatactggtcgttcaccctggttcctgcctcggagctcctgaaacccttgtaatttcctgggtgctaaaagtgtcttttgttctaatgaagcaactctaagtgggctcctggaggctcctgggtgactgatggtcatcacacacacaaaaaaaaacaagccatgatgagaagcttggaattttcagcaccacttcccattctctttggaagggagaagggctgaaagtgaaatgaatgattaatcatccccatatgatgcagcttcatgaaatcccaatagtaggaggtttagagagcacctgagctggtgagcacgtggaggtactgggagagggcagggaccccgagaccccctcccctcacacagctttctctatgaacctcttccattcgaatgctcatctatatcccttattatatcctttttataatgaaccagtgcatgtaagtaagggcttcccaggtggctcagtggtaaagaatctgcctgccaagcaggagactcaggtttgatccctgggtggggaagatcccctggaggaagacatggcaacccactccaggattcttgcctgggaaatcccatggacagaagagcctggcgggctacagtccatggggtcaccaaagagtctgacacaacttatcgactaaacaacaacaaatgtaagtagacttttcctgagttctgtgagcaactctaacaaattaactgatagttcagaggcgctggtaacaacctagacttgttattagcatctgagctagggcagggggagggagtcttgcaacactgagtccttaacctgtgggattttaaactgtctttagtagatggtgtcaggactgagttcaatggtgggacgctcacctcgttggggacccttggcatcagaaacaatattctgtgtcttataatcatggtacgtggaaaagaatatacatgtgcagatagaactgagtcacttggctctgcatctgaaacattttaagtcaactatacgtcaataggaaagtttcttcttaagtgatggagaaatttgagtccttctgatggttaatcttatgtgtgggttgactccccatggggtgaccagctcaaacattatttcagggtgtgtctgtgagggggttcctggatgagattagcatttcagtgggtggacctcacccagtcccagcaaacagtcctccccagtgtgggtggacatcaccgggtccactgagtgcctgaatagaacagaaggtggaggaaggagccaacatgcctggttgcctcagctgggagtattgtgggattccacctatgtgaggtaccgtgcatgtgtgagtgctaaattgttcaattgtgtctgactctttacgaccccatggactgtagcctgccaggctcctctgtccatgggattctccagacaagaatactggcgtgggttgccatgcccttctccaggggatcttccccacccgggatgaaattgcatctcttcttttctcctgctttggcaggcaggttcttaaccactagcactacctggaagcccatgtgaaatacgtagaatagtcaaattcacagagacagaaaggacaagaagggttaccggggtctggggggagagagagagagtgatttgctgtttaatgaatacagagtttatgttggggtgatgaaaacgtttaggtgtagacgatgctgctggtgatacaacactgtgcaatcatgtactgccaatgggttgtatagttgttgctgttcagtcactaagtcatgtccaactctttccccatggactgtagctcaccaggctcctctgtcctccactatctcctggagtttgctcagattcatgtccattgagtcggtgatgccatccaaccaactcgacctctgttgtcgtcttctcctttcgccttcagtctttcccagcatcagggtcttttccattgcttacctatccattgttaaagtgataaatgctacggatatttgactgtagttataaacacacagaaatagattctttcagaattctggaggctagaaatccaaaatgaaggtattgagggggaaaaataagggaaaaaagtaggtgagaaattttacttttttagtgaagtttatataatctacttccctgatggctcagacagtaaagaatctgcctgcaatgagagaggcccaggttcgatccctggatcaagaagattccctggagaagggaatggctacctactccagtattcttgcctggagaactctatggatagaggagcctggtgggctactgttcctggggtcgcaaagagtcagacacgacagagtgacttacactttcacttttttttgtatacaatctactgtgatagagccaacatcttaaatcccattggaagaaagtggggtgtaaatacatgcatatcacttcctctaagatatgggatagataagacgttctcttccacatgccgctgtcttcccttcactgactcatgctctctgccactgagtcttcagggaccacagcactgtgtaaacacgcccctctgctccatcctcctctccttcactgggccatgcccaggttaagacacccggggaaggcctttgggacctctaggtcttgggtagctgttcatcttcccagatgtcttttgggcaagtggtgtgagagtccccatctgtttcaggcagcgtccccttgcagtggtaggaaccaggctagctattttatgcagagatagatctattagccgattcatgtgcttgtagaactttcagaatggctacagaagaggcagcaagtgaggttcccaggaatgactcagagaactaacccaccaagggagcggcctctttggcatccagcagaagtcccagaatcaggaggcttctcagtatgggaacctccgcctccaaggacagagcacccaatagataaataaacaggtgcacccgactgctgcctctctgtgcctttagtcctcttcaaaattcaactctctcccagccccatctaatctgcacctcatgaatcatgttcataggcctgttggcaaggcaggctggcaaaggcagctttagcctctgcagcctctgcagaaaagaaaagcccagtggaagcagggtgggatgaaagaataagatcacacctgccacaccacttcatggaggtgttgggggcagtctagccagcatatcctgacatcctcatcatttcattcattatttattgccatttattgtaccaagggagggcttcctaggtggtgctagtggtaaagaacttgcctgccaatgcaggagccatggttttgatccctcagttgggaagatcccctggaggagggcatggcaacccactccagtattcttgcctagagaatcccatggacagaggagcctggtgggctacagtccatagattgcagagttggacacaactgaagcaactttcactccaatcctaaagaaaggcaatgccaaagaatgctcaaactaccacacaattgcactcacttcacacactagtaaagtaatgctcaaaattctccaagccaggcttcagcaatatgtgaaccgtgaacttccagatgttcaagctggttttagaaaaggcagaggaaccagagatcaaattgccaacatccactggatcattgaaaaagcaagagagttccagaaaaacatctatttctgctttattgactatgccaaagcctttgactgtgtggatcacaataaactgtggaaaattctggaagagatgggaatgccagacctcctgacctgcctcttgagaaacctatatgcaggtcaggaagcaacagttaggactggacatggaacaacagattggttccaaataggaaaaggagtatgtcaaggctgtatactgtcaccctgcttatttaacttatatgcagagtacatcatgagaaatgctgggctggaagaagcacaagctggaatcaagattgccgggagaaatatcaataacctcagatatgcagatgacaccacccttatggcagaaagtgaagaggaactcaaaagcctcttgatgaaagtgaaagaggagagtgaaaaagttggcttaaagctctacattcaaaaaacaaagatcatggcatctggtcccatcacttcatgggaaatagatggggaaacagtggaaacagtgacaaactttatttttctgggctccaaaatcactgcagatggtgattgcagccatgaaattaaaagacacttactccttggaaggcaagttatgaccaacctagatagcacattaaaaagcagagatattactttgccaacaaaggttcgtctagtcaaggctatggtttttccagtggtcatgtatggatatgagagttggactgtgaaaaaatctgagcgccaaagaattgatgcttttgaactgtggtcctggagaagactcttgagagtcccttggactgcaaggagtcccaatcagtccatcctaaaggaaatcagtcctgggtgttcattggaaggactgatgctgaggctgaaactccaatacttggccacctcatgcgaagagttgaatcattggaaaagactctgatgctgggaggaattgggggcaggaggagaaggggacgacagaggatgagatggctggatggcatcactgactcgatggacgtgagtctgagtgaactccgggagttggtgatggacagggaggcctggcatgctgcgattcatggggtcacaaagaatcggacacgactgagtgactgatctgatctgatctgatctgattgtagaatatgagcttcccaggtggctcagtggtaaagaaaccacctgctgatgcagaagacataagaaacgtaagttcgatccctgggtcaaaggaaatggcaatctgctccagtatccttgcctggaaaatcccatggacagaggagcctggcgggctacagtccctggggcctcaaagagtcggacacgactgagcgactgagcacaaagtaaaacgaggtcatgagaatagagccctaactttccagagtcagatagcatgatccagccacctctttttccccagactgagggggacaaccattctggttatcaatgatgtaacgggaaaactgtacaacaggctgcagacaagcagactttcagcagctggcccttgattggggcagaaacaactgagcagagaccctccctaacttaatggagcccaaagtcacagacacaccggaccaaatgcagctctagtgcacagggcaaggatatcattcctgatggactgttctataaagcaactcaggcagagtgctgtggactgaaagatgacctgttcccaaaaagcgcaggttgaagttctaagtctccttccctgtgaatgtgatcttatattcggaagtagggtcacattttgcaggtgtaatcgagttaaggcaaggtcatatgggattaggggctctgatcgcaatgactagtcaaggctatggtttttccattagtcatgtatggatgtgagagttggactataaagaaagctgagcactgaataattgatgcttttgaactgtgatgttggagaagactcttgagagtcccttggactgcaaggagatccacccagtccatcctaaaggaaataaatcctgaatgttcattggaaagactgatattgaagctgaaactccaatactttggccacctgatgtgaagaactgactcatttgaaaatgctgggaaagattgaaggtgggataaggggatgacagaggatgagatggttggatggcatcactgactcaatggacatgagtttgagcaaactccaggagttggttatggacagggaggcctggcatggtgcagtccatggagtcacaaagagtcagacacgactgagtgactgaactgaactgaatgcaatgactgatgctgaactgaagctccaatacttgggccacctgatgtgaagagctgacttactgggaaagaccctgatgccaggaaagaccctgatgccaggaaagacggaaggcaaaaggagaaggggcagcagaggatgagactgttagatagcatcaccaactcagtggacgtgaatctgaacaacctctgagagagagtcaaggacaggggagcctggcacacatggggtcggacatgacttagcaactgttgaacagcaacaacaatgcaatgacatttttttacagtattgtgttggtttccgccatacagaacatgaatcagccacaggtgtacatacatcccctccctcttgaaccaccctcccacctcccagtccatcccccacctctaggttatcccagagccccactgtgagctccctgcatcatacaccaaacgcccactggctactctacacatgggactgtatgtgtttccatgctgctccaaaagggagatgcagagacagacactcagaagagaaggccaggtgaagacggaggcagaggctggagagacacgggcagtcaccaaggagcgtctggagtcaccggtagctggaagaggcagggaagactgtgcccttagagctttcaaaacaaacacggtcctacgacagcctgatttctggcctccagaatggtgagaaagcacattgctggtgtcataagccttcgtgtcagcagcccttggaaatggatacacagggcaacctggaaaagagcaacaaaagatgacactcttcctgcagtcccttcataacaggagttttcctccactaaaagccaggttgcctagaatcagcctcccattcaccagctaaaacgtttcactggggctgctgaactctgctgcctggaagcaaagccagggagtggctgactcgtattcgcactgccttcctgcttcttactgtgtgggtctcccctgcccctggtaactggggtccctctacacttcctcttggccagaagtcctggttccccttcatctagcttcagagtctggtccagggggtgctcagtcatgtctgactcttggcaaccccctggactgtagcccaccaggctcctctgtccatgggattctctaggcaagaatactggagttgggtggccattttttcctccatgggaatcgtcccgacccagggatggaacctgggtctcctgagtcttctgcattgcagccagattctttaccactgagccatcgggaagcccagctccagaacatcccaccaaagtctccattcctacacccgctttggtagtcaaagggacacatctcttggcaccagaaaggtacctgctctcagatgacacgggacatctgagtttaacatctctacccccaacaagcccacaagagtacctggcccagaataggtgctctagagatgcaggtttgatccctgggttgggaagatctgctggaggagggcatggcaacccactccagtattcttgcctggagaactccatggacagaggagactggtgggctacagtccatggggttgcaaagagtcagacacaactgaagcgacttagcacgcacacagagacctactgaatgaagggtagccctgcctcttggacttctgcaccttgtgggcatcaacatcaagaggtgcagacagccaggactaagtggcagagatgtttttaagcaagcagatcctgcagtgccttttaaatcactcttatctgtgtagggcttccctggtggttcagatggtaaagaatccgcccacaatgcaggagacctgggtttgatccctgggtcgggaagatcccctggaggagggcatggcaacctactccagtattcttacctggagaatcccatggactgaggagcctggcgggctatggtccatggggtcataaagagttggacacggctgactaacactttcgatatctgtgcaggagcctctgggttccccagaactgatccttctgccaggcttgatcagtctgatggaaaacgctaggtacctgaccaggtgggcagccctggagggcctctttgtcctttacatttgctttctccctcacatttgcactctcccttcctccatttcttctctctcccagtttttataaaggggtgtgggcccttgcccagtcaatgttagtaatatcatcgcagaatctgacctgtgcaaagcccttggccacgtttttgcaagtccataacataacactaggtggcagtgtttccacggcttgctgtcccttacccagccaggctcctctgtccctgggattccctaggcaagaagactggagtgggttgccattcccttctccaagggatcttcttgacccagggactgaacctaggcctcccgcactgcaggcagattctttaccgtttgagacaccagggaaacccccttcaccttgaaacttgctagaaacgctcccacagacacaggaggttgttttcaggtatttaaggagggagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagactagcctgtttctgaccctcggtgatgacctgggaggaggggtgggggtgaagggagcagaactcagcagtaaagcccagtaagccccatgatcaaaagtcacaggtcctgggtcacagagacagggagacggtccaggtggaaggggtcttgtccattgtgctgacttgccctgctggttcaagacaactcccagggctgaatgaaaagtgttagaacttctgttctgttggtttctatcttgaaagaaagagaagaaggaaggaaggagagagagggaggaaagagcaaggaagaaaggagagaaaaagaaaagtgtgctctgtccatctgccatgtgggttgaccgaggcgcacattctcactgcaggagccagactggcagatgtcatggggtgcgccaggcacctggatgggagctccaggtggtgtgcattgatgccacttttcaaatcttccttgttccagaattttgctgttattgaagattccaaattcccatgaagagaatgtgcagattgtattatctagcttttaactaaatgaatcctcatgaaagtggacaaagatgtccactgaacaagggcgtgaaggcattgctaaggcagcacgcagaggtggacaagaagggggagggctggcacttttctactccagggatgagccaccgccagccaacttagaaagtctgatccttgacaggagttttaaataaatgaacaggtttaacccatacattcaagctcaaggtgacacttcactgtgagtgagaaagtaaccactgccagaaacacgtgctaggatgagaatattctgaaaaagaaattgggaaaggtttctatcattaagtgattttattgcagacaaacgaagtgtgaatctataaaagctctcatatctcacattttaaaacttggaaacacgactttctaatatgttaaaaagcttctgagggattctctgggttttaaaacccatttgtgaaacatataaaaacagagtttcctattaatttgcaagaaccattctctgatagcaaagagcatggaaatatactaactgcacctcaacaacaataataataataaacttttgcatacttgggagatggggttgaaaactgaatattctgagttaacaagcagagcacacaatacccactatggttttccaaaaggatgaagcatgttcaatcacactgaaatgaagcagggccctgtggtccttgaccccaaccgtgtctcctgcctgccttttgtctgtgcaaagctttagtcacagagcaagtttgatcagaggagtgagaaatgcagaaacgaaacagtcnnnnnnnnnnnnnnnnnnnnnnnnnnnnnnnnnnnnnnnnnnnnnnnnnnaaaacaccaggtggggaagctaactacgtgacgaccagacggtacccaggagatgagctgccgcaattccgagaactgatctcatcgtaaagaaatggggacaagtgcaccctggaactgaagattagctgtacctgaaacaagctgatgctggtgagaccactgatgaccgatttaaagatgactgctagagacgactgtgctgtttctgcatgtagccccctgccccctctgtctataagagctctcgcctcctgcttgtcaggatgggggagtgggcctttggacagacatccccctgcctcagttgccagcgtctgaaataaagcaaaccttcctttccaccaacctggcctctttatgggcttttgagcagcaagcagcctgacccacacaatccttttggtaacagattttggtgcccatctcttagacattattaaaagtaactgaaagtaatagaagatttttgaaaaaacaaaatcattttgattgttggtaaaggctttgccttcgtttatcttccaaactagaggagatgaagatgaaaaaaatataatagacatttaaacctgtgtttattactccttttttcatacttttaaaatttctatttctgtgtatattttatgatatgcataacatgtatcatgaagagttggggagacagataattcacaaataaatgtttttaaatgtatataacatacagctttgttgttgtttagttgctatatcatgtctgactcttgcgaccccatggactgcagcccgccaggctcctctgtccatgaggattctccaggcaacaatcctggagtgggtttgccatgccctcctccaggggatcttcctgactcaggggatcgaatctgcatctcctgcatctcctctgttggcaggtgggttctttaccaccagcgccacctgggaagtccatacacagctcagtaacacgttattatgcacattatctgcatgtgtttctatatgcatagatgaagaaggaacatatattcacatacagtatttcatataatatatactagatattgattgtgataattttatattacatgttacattatatattagatataaatactacatttctttatattaacacatattataattgtccatatgtatttacatactgtaatttacattatactacatctgtgtgtatgtgcaatcctcctacattttcccagtccattcattctcccacctagaagaattctccaccttttcttaacatgccttaaactctccatgcctcatcctcatcctcactctcagctgatggcattgcttcctatttcacagaggagatcaaagcatccacagagaaccctcaccatccccatcatcctcacgatatcacatcaccagccaccagccaccaggcatctgtgctgagcttgctgccttctttccacaacagtgaacagaagcaagtcttccatccagggcctgcctctacactcctgttccaggtgccctcccctcctatctgcacagagaaagcttcagaaaccctcccatcccatgccacctagtcagcgtacaaacctggggtttcttctcccatgtgtaaacgtacaaccaaaacctcttcccctcctcccacttcttccagcttctgtcccatttctctgtgcccctcaacagcacaacctcttgagtcacttaaagtcattgcctccaactcttcttctctagggcatttgtgcatgcatgctcggtcacttcagtcatgtccaactgtttgtgaccccatggactgtagcccgccaggctcctctgtccatggaactctccaggcatgaatactggagtgagttgccatttccttctccagaggatcttctagacccagggatcgaaccctcttctcctgcatctcctgccttgcaggcggattctttactgactgagcaaccagggaagcccatttactttccactctttagggcatttacttcccactattttgccaaaatttctcttgctgaggtcagtaatgacttccaaactgtgaaatccaaagctcacttcccaggggttctcaaggtcagccagcaagccagctttggacacggaggacctttctctgcttgaagccctctctggcttggttgccaggacaccccacctgtgggtggttcctgtatctctgaccagcctccctgggcacctgctgactgatgactgagctctcacttctagcctcactctgaggcagtctctctggacagcctcatccttttaccttccacctagagttgcattccccagtgcaagacctcagcctttcctgctgaactccagattcactacccaactgcctccttgacaaccttccctttcaggtctaagtggtctctcaaggctaagttgccccattgtgagctcctgataaatgtttccctccctaaggttggctggttcactggtggctcagatggtaaagaatctgcctgcaatgcaggagatctgggttcaatccctgtgttgggaagatcccctgaagaaggaaatggcaacccactccagtattcttgagcttcccttgtggctcagctggtaaagaatccacctgcaatgtgggagatctgggttcgatccctgggttgggaagatcccctggaggaaggcatggcaacccactccaatattcttgactgggaaatcccatggacagagcagcttgatgggctacagtccatagggttgcaaagagttggacaggactgagaaactaacacactcgagggctagagctagttccttcctgatggttgggcaatccacaagtcttatggttgaccttgactccctcctttctcctagtgtggtagatataataacggtcccccaaaaagatttccagatgcacaaacccagaacctgtgactatgttacctttcagacaacaaagactttggaaatgcgattaaaattgggagaggatctgtatagataattcaggtggacaccacaatgttatcacaagggtccttgtaagagagagaccaaagggtgaaggtcagagtgggagatgtgatggtagatacagaacttggagtgacacagggtcagaagccaaaaagtgtggtcgcctttagaactgggaaaagataagaaaatggatttccttctagaacctacagaagaagcactcattttagaggtctgacctccagaatggtaaaataatttgggggtgttgtttagccaccaagtttgtggtgttttgttacagcatcaatagggaaggaataaactaaggaaattctgttgtggtgttggagaagactcttgagagtcccttggactgcaaggagatccaaccagtccatcctaaaggaaatcagtcctgaatgttcattggaaggtctgatgctgaagctgaaactccaatactttgaacacctgatgcgaagagctgacttatttgaaaagaccatgacactgggaaagattgagggcaggaggagaaggggacaacagaggatgagatggttggatggcatcactgactcaatggacatgagtttgagtaaactctgggagttgctgatgtgtagggaagcctggcgtgctgcaatccatggggtctcaaagaatcagacatgactgagtgactgaactgaactgaagttttaaaataaagcaagaatcttactactttttcacaacttcaggtctcctacccttatccaaatccctatcacttctcacctggattattgcagtagcctcctgactagtccccagcttccaccattctccccacacagggaactgggcatgtaactcctgagcgagccattctgacagtcaaaagaaagtcagatcacattagttgttttctgttcaaactcttcaccagctctctctctctcaatgggactgaaagccagaatcttcactgtgcccaacaaagccctttagaatcagacccttccacatctctgacctcagcgttactcatgccccgaccactcactccagccacactggcctttgaatgatcccttcaacagcctaagcagccactgccccagggcctttgcacttgcccctctgcctggcatgctttctcctagaagagggcatggcatctgtcacagtgaaaagtaaaaaaaaaagaatgagtttttctctctccctttcctaagaacaaagaaaacaaagtgaacagtgaattggcctgaatattactagttttttttttttactttcagttcagttcagtcattcagtcgtgtctgactctttgtgactccatgaattgcagcatgccaggcctccctgtccatcaccaactcccggagttcacccaaactcatgtgcgtcgagtcggtgatgccattcagccatctcatcctctgtcatccccttctcctcctgcccccaatccctcccagcatcagagtcttttccaatgagtcaactctttgcatgaggtggccaaagtattggagtttcagcttcagcatcagtccttccaaagaacacccaggactggtctcctttagaatggactggttggatctccttgcagtccaagggactctcaagagtcttctccaacaccacagttcaaaagcatcaattctttggtgctcagatttcttcacagtccaactctcgaccactggaaaaaccgtagccttgactagacggacctttgttggcaaagtaatgtctctgcttttgaatatgctatctaggttggtcataactttccttccaaggagtaagcgtcttttaatttcatggctgcaatcatcacctgcagtgattttggagcccagaaaaataaagtctgacactgtttccccatctatttcccatgaagtgatgggaccagatgccatgatctttgttttctgaatgttgagctttaagccaactttttcactctccactttcactttcatcaagaggcttttgagttcctcttcattttctgccataagggtggtgtcatctgcatatctgagattccagcttatgtttcttccagcccagcatttctcatgatgtatgtagacatagaagttaaataagcagggtgacaatatacagccttgacgtactcctttctcaatttggaaccagtctgttgttccatgtccagttctaactgttgcttcctgacctgcatataggtttctcaagaggcaggtcaggtggtctggtattcccatctctttcagaagtttccacagtttattgtgattcacacagtcaaaggctttggcatagtcaataaagcagaaatagatgtttttctggaactctcttgctttttcaatgatccagcagatgttggcaatttgatctctggttcctctgtcttttctaaaaccagcttgaacatctggaagttcacggttcacatattgctgaagcctggcttggagaattttgaactagtaaatttactttactagcgtgtgagatgagtgcaattgtgtgatagtttgagcattctttggcattgcctttctttgggattggaatgaaaactgaccttttccagtcctgtggccactgctgagttttccaaatttgctggcatattgagtgtgtcactttcacagcatcatcttccaggatttgaaatagctcaactggaattccatcacctccactagctttgtttgtagtgatgcttttaaggcccacttgacttcacattccatgatgtctggctctaggtgagtgatcacaccattgtgattatcttggtcgtgaagatcttttttgtacttttttttactttaactgctcctaactcagcatgtctgtaatgaagtttacttttctgccgcctaactctgcaggagctacacttcacacctattttcctttgactctatgctaaatacatcccctatctggtgtttacccttacattacccttctccttgtagttacagatcagaaagaaggctgcagagccactgaactgccagactccatgaccgggttgctgatgccagtctatgactgtctttgaaactatgcaagaggaagaaatcaagatcctatcacctttgttcctcatcaccgactcctgactgtgagccctctttttaaataagcccgtagactcctaatgggcggtgtgtgtgggggggtggggggcacagttcttgaggcatgagcctactgtattcccctctctgccggctgagaattaaagtcacctttctatttcctccaaactctctctgaattttttattcctcttcagtaggcagagaaagccaagatttcggccatcaacacaccctcttcctttctttactcatggttttccctggctgacctagctgaggtcctttcctccgtcccccatctctacacacagtttctgatccctcttcctgctgcattgtttgcttcttagtacttatcattggatggcttacatgttatatttataaccaacaactacatgttttctctacatatcttctttactgcccacccctccccctaaaaaaaaaaaaaaaaaaaaaaagatcaccactagaaagtacatttcatgagggcagaggggttttttgtctgtgctgtgtgcaccccaatgagaatgggagcccccagagtcaaagtaagggtgggactgggcctgaacaaagatggcttggtgctgtccctctagccctcctcctggtgagctcctgaatcctgaacactcagttgctttatgctacactccaggcactgttagatgtcacaggcaaatatcatatggctcctacagtacagggaacccatcacagtggttaaaactgttggggacgtttgtaatttccttggttttgtcccatcgcaacaaaaatttgaagtgacagacggagcagtgttacagccccgtgttacagctcagttttatttagaaagttaaggaaaaatactgttggtagcttgatagggattgcactgaatctataaattgctttgggtagtatactcattttcactatattgattcttccaatccatgaacatggtatatttctccatctattagtgtcctctttgatttctttcaccagtgttttatagttttctatatataggtctttagtttctttaggtagatatattcctaagtatttaattctttccgttgcaatggtgaatggaattgtttccttaatttctctttctgttttctcattattagtgtataggaatgcaagggatttctgtgtgttgattttatatcctgcaactttactatagtcatttattagttctagtaattttctggtggaatctttagggttttctatgtagaggatcatgtcatctgcaaatagtgagagttgtacttcttcttttccaatttggattccttttatttctttttctgctctgattgctgtggccaaaacttccaaaactatgttgaatagtaatgatgaaagtgggcacccttgtcttgttcctgactttagaggaaatgctttcaatttttcaccattgaggacaatgtttgctgtgggtttgtcatatatagcttttattatgttgaggtatgttccttctattcctgctttctggagagtttttatcataaatgggtgttgaattttgtcaaaggctttctctgcatctattgagataatcatatggtttttatttttcaatttgttaatgtggtgtattacattgattgatttgcggatattgaagaatccttgcacccctgggataaagcccacttggtcatggtgtatgatctttttaatgtgttgttggattctgattgctagaattttgttaaggatttttgcatctatgttcatcagttcgaatagccaaagcgatcctgagaaagaagaatggaactggaggaatcaacctacctgacttcaggctctactacaaagccacagttatcaagacagtatggtactggcacaaagacagaaatataaatcaatggaacaaaattgaaagcccagagataaatccatgcacatatggacaccttatctttgacaaaggaggcaagaatatacaatggattaaagacaatctctttaacaagtggtgctgggaaatctggtcaaccacttgtaaaagaatgaaactagaacactttctaacaccatacacaaaaataaactcaaaatggattaaagatctaaacataagatcagaaactataaaactcctagaggagaacataggcaaaacactctgacatacatcacagcaggatcctctatgacccacctcccaaaatattggaaataaaagcaaaaataaacaaatgggacctaattaaccttaaaagcttctgcacatcaaaggaaactattagcaaggtgaaaagacagccttcagaatgggagaaaataatagcaaatgaagcaactgacaaacaactaatctcaaaaatatacaagcaactcctacagctcaactccagaaaaataaatgacccaatcaaaaaatgggccaaagaactaaatagacatttctccaaagaagacatacagatggctaacaaacacatgaaaagatgctcaacatcactcattatcagagaaatgcaaatcaaaaccacaatgaggtacgatttcacaccagtcagaatggctgcgatccaaaagtctacaaataataaatgctggagagggtgtggagaaaagggaaccctcttacactgttggtgggaatgcaaactagtacagccactatggagaacagtgtggagattccttaaaaaactggaaatagaactgccttacgatccagcaatcccactgctgggcatacacactgaggaaaccagaagggaaagagacacgtgtaccccaatgttcatcacagcactgtttataatagccaggacatggaagcaacctagatgtccatcagcagatgaatggataagaaagctgtggtacatatacacaatggagttttactcagccattaaaaagaatacatttgaatcagttctaatgaggtggatgaaactggagcctattatacagagtgaagtaagccagaaggaaaaacaccaatacagtatactaacgcatatatatggaatttagaaagatggtaacaataaccctgtgaacgagacagcaaaagagacactgatgtatagaacagtcttatggactctgtgggagagggagagggtgggaagatttgggagaatgacattgaaacatgtaaaatatcatgtatgaaacgagatgccagtccaggttcgatgctcgatactggacgcttggggctagtgcactgggacgacccagagggattgtatggggagggaggagggaggagggaggagggttcaggatggggaacacatgtatacctgtggtggattcattttgatatttggcaaaactaatacaattatgtaaattttaaaaattaaataaaattgaaaaaaaaaaaaaaaagaaagtaaaggaaaatacattttcgtggtgaggggagaggggctgacccaagagctgggaagagaagagaagccccccggcccaattttggctcctcttcttatatgttcttttcttctctccctgggcctgccctatgtaaattgggctagccaggaggctgtatgttttacctgaggtcctcactccagtcctcggaccttcctttgttctattctcccaggcttttcccttctttgtcttttagccacagccattctgaacttctttttcttattctaactacctaacagaccagcccagagaaagggcactggggagagacaccagtgatgtcctacccccaccactaaaacaaaaaatgatgatgccagctagatctcaggacaggcttgtgcacacaggtggcttcccagtaaggcagggggcagatgggctccaggcgaggcatttataatcagcctcctgtttacatttcctgaggaaggaggcaggtgggctcgaggctgggtgtttacaatcagctacctgttttgaacttcaaaatagaaataacaacaggaacagggtgaatagccaggctttgtctcctgaggacacttgacgataacagtcttagcagagacagagaggctaaaccctgtttgagtagaagataaagtggtcacatatttcccctccttggggcaagggagacactgcacaggtacaggaaaggctccttgggggtcaaaaaggagggggcaccatcccataatatgtgatgctagggccatcccataggcctctgggctggcattcatctcaggaaaaagttgtacacacatgttggggagggtcctagggccagcaggtatggaaaaagaaaccacagaattggccaaaggtaaacaaagagccagaaaaactgccctatataaacgacttaatcgcctctttactgctctcctcattagcggggaggcccataccctttctctctgggtgtgcatctctgtcttgtttctgtcttaactgtttctctgtgtgctctcccacttgtgctgtgtctctaataataaactttgtacctgcttttacagtttttgcctccttaagaaatgcatttttcaatgaggacaagggtcagggggagtttgcttctagtctctaacccctggtggtctagtggctaggattcctggttttcatccaggctacccaggttcaatttctaagcagggaattaagatctcacttcaagccacggctcatagctgcctctccaagatcaccaggacaggctctcgatagactgggcatgaagtggaacaaatcgttaatgtaccatccggttccatccagttcacggtctaaagaaggactcataacaatcataacaggtaacttgtccctagacccagcccctgccctgatttcataccctagaagctggccagaggggaagagtgatttacctgttagccctttgttaaaagattttaacccagaagagaaaggggtctccaagtgggagatcaagggtaaaacgatgatctttccatgtgtcaggaagaggctgcacaagatatctaacccatgcaacacttctgaaaggaagcaatttccattgcttttctataccagagaattcagagactccaacaagtcaggtgacttccccagcaccatggagataataaataaaggacagaactggaatttagaccagatctacctggtgtctggagctatagaggagactgtgtgatattattacaggagtggtcattttacatcaacacaaagggagacattttgaaccatgagtgctcactgaaaatgcacaacatgtgaactttcaaaagtggacacacatttgcttaagtgtccatcccccatctctgatggcctcaagatggcccccagtggcagcctggttactggataaccgctgaggtctggtttccaggaccttcccagggcctggctgcgttcttgcctttggctaccctgagatgcccaacatcctgaatttaaaccagctccatgggttttggttagttgcaaccacaagaatcctaagtcacataaaaggcatacgagtgtcagtacttctaaaagagaacttagactcttgagagtcccttggactgcaaggagatccaaccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggccgacagaggatgagatggctggatggcatcactgactcgatggacgtgagtctgggtgaactccaggagttggtgatggacagggaggcctggcgtgctgcgattcatggggtcacaaagagtcagacgtgactgagcgactgaactgaattgaactgaaagtccactgaaatttctttctaagcttggaaaggcaaagtaaccaaattcctttctccaaaacatgatttataactctggctttctgatttaaaaggcacttagaagaccattaaaaaaataaggatttttaagggattaagaagtacaaactatcttgtacaaaataagctacaaggatatattgtacaaaccaggtgcacataaccaataatttaaaaaataacatatttttaagaggggattttaagaatgaaccttgagtaggaaaaacattcatttctctaaaataaacaacaacaacatatgtattttcattcacttgacaagacataataataaaacagacactttcagttgggttatttaaagtgtttactcgtatgagcagtctttggaaaattgtattttttgtaaaagcaaacactcagaaagtcagctatttgccttctatcttaagttttgaagggctttcctggtggctcacatggtaaaggatctgcctgcaatgtgggagacctgaattcaatccctgagttgagaagatccctggagaagggaacagctacccactccagtattctggcctagagaattccatggacagaggagcctggcaggctatagcccatggggtcgccaagagtcagacattatggagcaactttcacctttactcttttaagtacctgtatgtaatttcccagaatgtgcagaaatgcctttggttcatttaataagcattcagcaggtgcctcctgcacagagcccccttcaatttccagaacagtatagaagccatctcaagcaagtgtcctacagctaaactttcccacatggcaaatgaataggctgctctatctgcctataaacacaggcatctttgagtaaccagtctgcaatcagagataagaaacaggtactaagaacacaaagaaccaaaggtggatttctcagcacctcttcatcttctctgtgttttgtaattgtgaaggctgacatgaaggaagtgtgaggggaaaaacatgagtgagaggtggtgggatacactcattgaaacgtgcacccatttcaaaaagacaaaaatcactaaaaacaactctttactcatgttggttctccttgagaaatggaatattgcctgccagatcagtaaacaaaggatgtcacagttagcagtgattgcagccacccctggacgagctggtgagccctgagggaactcaggaaggaaggaatacctgccatctagcagccatcagactgcagccactcccaatggtgagctctgatgaaactcaggatgtaaaaacacaggatgttgggccctagagagctgaagtgcttatcaaaggggatttcagtgagcccacacatagaaaactgctcaattccttaacttgggatatctggttttctttaactcacaatcatctttttgatgctcagactacctgccatttgttgcaaaaattctatataacctggctccttccctcacatccttggagcagttctctcagggttacttgagatgctgcctcccaggcttgaagtcctaaaaattcctgccaaatgaaacagaactcaacttttcagttgtgaaaatactttttagtcgacaccttcctctctgggtatctgaagatttggatcaaatctgctccttctgttgcaggaaaggggaacctcttccagggcccaaagggggcctcctgattaacactcggaaatgaactgcctgaggagacacacatgctgacaaagcaagagacattattgggaaggggcaggagggagagcaggagggtcagggcatccaggaggactgctgtgccacgtggctcacagtcttggcttttacggtgacaggattagtttctaggctgcctctggccaatcattctgactcagggtccctcctggtggtgtgtgtattgctcagccaaaatggatgtcagtgaggaggattctgagaggtggtaggacacttggtgtctccatttgacattttctgaactattccagttgatggtggcttattcattctgttttcattatcaggacctcctgatgtataataactcatgggaatggttaccatggtacatggtcaaggtgggtggtttcagtcagtgtttgccctaacactttgaaccaattaggagggaagtctccctagttacagtccaaagcaggaggcaaggatagatcctagattccactgccactgctcaaaaaagagacacagcaatgaattcccaaaggatacattaggaatttcatactggctttatggtgaaatagctttcaaaagatcactctcaaatttaattgatttcatccttataaacatccacactcatatgtaagcagcctgttttgcttagtttctccctgtgctgttggcagctcacgttttctgtttttttccctccttgggagagaccattgatcactgttaatttttagagttggtggtgaagagacaggcagtgtctacctttcttaaagatgtaagatactataaatttttattttctagacagaaagaagtatttgaccttttattactaaagatgtcacctgcaagaaccttgggtacccagatgtggaaggcatgacagtaatcctatttgtggagagtgtcaatgaaaaaaagttgcctgtcatatcagtaaacaaaggatgctgcaaccaccaagccaccagctgacacccaccccaaaggtgagccctgaggagactcaggatgagaaagcacagtacactggccccagatagctaaagtgcatatcaaaggtatgattttagggagccccagagtcacttgcatcttctcatacacagaaaaatgctcagctcattaacttaagaggtctggttttctttcttcaacagcagtaatcttttgatgtttcaactgaggaaggaggtagatgccccccacccccaacccagggtaaagcaattggagagtcattccctgtggatcaaaactccaagatgagaatagtaggacagttaaggcgagaaggctgggccctactcggaccacttatttcttgttcttgaagtcaggagacctccctgaccacacatgggcagaaaaggctccttgcaggtcaaagggaagttatgtcaaggggtgttctattcagatgccttttcggtaaaatccatcttggctaagagacgtgtgtgcacacatggaaggaccctgagacataccaaatatggactgtgaaccaggttaattataatgattgaccaaaggaaaactcggaggaaatgccccatgagagtaacccaaactgccacaaaggcaagactcagcaactcaggaactcgccctctgagtctgcccatgtgtctatccacatgtactgtactcttttcctcttaatgaatactttacctgcttcactactttctgtctttgtggaaactcttctctgtggaaactagaaaataaaaatttaaagtatcttacatctttaagaaaggtagacactgtgcctgtcccttcaccaccaactctaaaaattaacagtgatcaatggtctctcccaaggagggaaaaaaacagaaaacgtgagctgccaacagcactgcttacataagagtgtggaagttgaaggccagaacctgaatctgtgctttccccactgtgacccagctcaatctctggctgggaacccaagccctgctccaagtcattgcaagtggaggccacttgagatcatatctctctgatcttttttttcaaagactcctttatattctggctcctcccttatctctcatcaaaacagtctctcagagcaatctgagaggctgtctccctggctgaaatccttagtatgttcactgaataaaacgtaattctcaagttttaggctgtgcttccctcccgccagccccctccccgcccccctgcccctcccagtaacacagagcttccattatttcactctgatatattgacagctctctcaatggacatgagtttgagcaaactccaggagatagtgaaggtcagggaagcctggtgtgctgcagtccatgggatcacaaagaggtcagacatgacttagcgactgaaaaacaataagaacaacttcttgcctcaaccagctctcccaatgctggccctgcatctgtgagaatgggccctgcctggccagctctctctggcatcattactttgaactgacaccacctcttactttctattctcaacctcctttcctctctctttccccttctttttctctgtccttctctttattttccatgtcctctacttttctctgccatgtttctttggttcctttcctttttctgtagtccctacagcacaagctgaaatcaagattgccgggagaaatatcaataacttcagacatgcagatgacgccacccttatggcagaaagagaagaagaactaaagagccttttgatgaaagtgaaagaggagagtcaaaaagttggcttaaaactcaacatttagataattaagatcatggcatctgatcccatcacttcatggcaaatacacggcgaaacaatagaaacagtgacagactttattttggggggctccaaaatcactgtagatggtgaccgcagccatgaaattaaaagacgtttcttcttggaagaacagttatgaccaacctagaaagcatattaaaaagcagagacactactttgccaacaaaggtccatttagacaaagctttggtttttccagtaatcatgtatagatgtgagagttcaactataaagaaagctgagtgctgaagaactgatgcttttgaactgtggtgttggagaagactcttgagagtcccttggactgcaaggagatccatcctaaaggaaatcagtcctgaatattcattggaaggactgatgctgaagctgaaactccagtactttggccgcctgatgggaagaagtgactcattggaaaagaccctgatgctgggaaagattgaaggtgggaggagaaggggacgacagaggatgagatggttggatggcatcactgactcaaagggcatgactttgagcaagctctgggagttggtgatggacagggaggcctggtgtgctgcagtccatggggtcacaaagagtcagacacaactgagcaactgaactgaactgatagtcccaaaaggcagaggcagtgctgggatgggagaaaagaagctcgtgtcttgatttgccatttgctgtgtgtttgcttgtgggaaggtcattccatttctttgagccccagttctacgaacctggagtaataaaaactgtttgtgagaacctggtgaactggcttaggttcatctcattaactatttaagatccacccaaataaaattgatgtcattactggagtcatataaacaactccacagtgataccctctttacaagggagaggagagagagaaagacaggaatctaaaatcactgaaggattgggtgacatcgtatcttagtgatgattcaccacattccatagtcaactacaggtaactttgtcttcaccacttgcctgaggtggaacttgctctttttgtaacagggaagagtgaaatctgactccaggttggttctatttctcttactttaaactttgcttttccttgcttttattataatcaatggaaggatgctgtctatagctgcaaacactcacaatggcctgtgtgggtgggagggaacctgcccacctgtgaatggctacagaaaagaaggaattaacagatcctcatcccaatgctggccaagccaggagatattttgcaagactaatggtctttttactttacttcctcacctcctcctgctctctgttctataaaagaaactggtatccagaccccaataagatggtactctagagtgccatcttctcagacacctggctttctaaataaagtggctattccttgcctcaatatctcatctctcgattattgtgtggtaagcagtcagagcttgaattcagcaatgtttcctcttttagtttctttcctttgcacttgttgtccagcaggtccagtttgcttgccgtcagtggtccaggtaaggcaggtaaggtaaggcaggattgaaggagcttgctgtcctaagggtaatgaccacacagacctaaccacaactcagctgggtgtaatttttcaaaactggtgtctcagccactttgttacctttttcctcatatctggctgagttttcagtgggtttttcactgtgatgtcacccactctgtgacactccatctcttccctcatggcctttatcacagtctcattttgtaaatatcagctttattgaaatataatttatgtaccataaaattctccctttcaagtataattcagtgatgggtggtatattcatgaagttgtacacacatcatcacaatccaactctagagcattttcttcaccccacaaagaaaacttgtgccctttagcagacttctgtcgacttaaaaaatattcacaactgaaagttatccacagcctaaaagttgagaatctttatacagcaggaatttttacaacttcaagcctgggaggcagcacctcatgtatttcttggaggactcatccaaggaggtgaagtcaggaagccagagttttgcaacaaagggtaggtagtctaaacatcaaaacattactgctaattaaagaaaaccagatatatcaagttaaggaatttagcattttttaatatatgagaagaccaagagtctgggctcactgaaatcattcctttgacatgcacttcaattctccgaggccagccccttgtgttttcacaccctgagtttcctcagggctccgtgtagggagtggctgcagtctggtggctgttagacggcaggtattctttcttttctgagttccctcagttcagttcagtcactcagttgtgttccactcttggcgatcccatggcctgcagcacgccaggcctacctccatcaccaactcctggagcttactcaaactcatgtcctttgagtcagtgatgccatccaaccatctcatccttgtcatccccttctcccaccttcaatctttcccagcatcagggtcttttccagtgagtcacttcttcccatcaggtggccaaagtactggagtttcagcttcagcatcagtccttccaatgaatattcaggactgatttcctttaggatggactggttggatctccttgcagtccaagggactctcaagagtcttctccaacactacagttcaaaagcatcaattctttggtgctcagctttctttatagtcaaactctcacatccatatatgactaccggaaaaaaccatagctttgactggatggaccttcattggcaaagtaatgtctctgcttttgaatatgctttccaggttggtcataacttttcttccaaggagaagtgtcttttaatttcatggctgcagtcactatctgcagtgattttggagcccaagaaaataaagtctgtcactgtttccattgtttcttcatctatttgccatgaagtgatgggaccagatgacatgatcttagttttctgaatgttgagttttaagccaactttttcactgtcctctttcactttcatcaagaggctgttagttcttctctttctgccataagggtggtgtcatctgcatatctgaggttattgatatctctcccagcaatcttgattccagcttgtgcttcatccagtccagcatttctcatgatgtactctgcatagaagttaaataagcagggtgacaatatacagccttgatgtactcctttctcaatttggaaccagtctgttgttccatgtccagttctaactgttgcttcctgacctgcatataggtttctcaaaaggcaggtcaggtggtctggtattcccatctctttcagaattttccacagtttgttgtgatccacacagtcaaaggctttggcatagtgaataaatcagaatcagatggttttctggaaatctcttgcttttttgatgatccaatggatgttggcaatttgatttctggttgctctgccttttctaaaaccagcttgaacatctggaatttcacagttcatgtattcctgaagcctggtttggagaattttgagcattcctttgttagtgtgtgagatgagtgcaattgtgtggtagtttgagcattctttggcattgcctttctttgcgattggaatgaaaactgaccttttccagtcctttggccactgctgagttttccaaatttgctggcatattgagtgcagcactttcacagcatcatcttttaggatttgaaatagctccactggaattccatcacctccactagctttgttcatagtgatgctccctaaggtccacttgactttgcattccaggatgtctagctctaggtgagtgatcacaccattgtgattatctgggtcatgaagatcttttttgtattctggttcatgaagatcttctgtgtattcttgctactgttgttaatatcttctgcttgttaggctcataccatttctgtcctttattgtgcccatctttgcatgaaaagttcccttgatctctctaattttcttgaagaaatctttagtttttcccattctgttgttttcctctattttgctcaggactcaccaattcactgtcaggtggtggttgcattcctgatgactgtgacattctttgtttactaatctggcaggtaatattctatttatcacttccccttctttattctcccattccctggcaactgctacctactttctgtctctgtcagttaggctattttggacattttatgggcttccctggtggtgctagtggtaaagaatctgcctgccaatgcaggaaacatgagttcaatccctgggttgggaaaatcccctggagaaggaaatggcaacccattccagtattattgcctggagaaccccatggacagagcagcctggcgagccatagtccacagggtcacaaagagttggacaccactgaagtgacttagtacgcatgcatggatacttcatattaagggaaacatagagtagctggacttttgtgactggcttctttcattatcatgtttcaatgttcattcatgttgtacatgaatgtacatgaatcagtacatctctttttatggttgaataatattccattgcatggatctacatctggtttacccattcatcatttgatgaacattcgggttatttctactttttttgctattgtgaataatagggctatgaaccttcctgtgtaaacttctgtgtggacacatactcccatttttcatgggtctttacacaagagagcaactacttggtcaggtgacaactgtgtgtttaagtttttgagtaactgccaattttttttctaaaatggctacatcattttacattctcaccagcaatatgtgatcggtccaatttctcgagaccttcaaatgacattctattttataagctgtctctgcatgtgtatcactgttcctcttggatttaaactcctagagggcatgaactgcactgaggctgtaaaaatagcaatcacagcacaggccaggttctgaacaaatctcacttgtcagttggatgaacttttttttattataatcacttacagtttcaaactagagggttgctttaggagaaagtacaggtctaatttcacatcttccaaagacgtctacacagaaaccccacttattgcgcccttacaggatacttgccatatatgatcttatttttcagatgaggaaactgaaatccaggctactcttccaagtaattaagggcaaagctagactttgctgctgctgctgctgctgctgctaagtcgcttcagtcgtgtccaactctgtgcaaccccacagaaggcagcccaccagactccgccgtccctgggattctccaggcaagaatactggagtgggttgccatttccttctccaatgcataaaagtgaaaagtcaaagtgaagtcgctcagtcgtgtccgacttttagcgacctcacggactgcagcctcccatgctcctccgtccatgggattttctttagacccaaattttcactgaaccacattgccctttacggtgaagaaattctacctattttgtaataaagggggagggggcaggggggagagggagaaagagacttatttaaagacctttttttcccgcgtccataaactccccaaaggcaaggaccaagattttgttgcttttgttatctcctactgtacacctggcttctcaggtggcgctagcagtaaagaacctgcctgccaattctggagacgcaaagagatttgggttccatctccggttggggaaggtcccctggaggagggcagggcaactcactccggtattcccggtattcttgcctggccaatcccttggacagaggaggctggcagtccatagggatgcagtcagacaccactgaagcgacttagcacgcacgcaggaactcggttcatagcagtaattcaaagactacttctgtgaacaatgatataatgactaataagctaaaaatctaaaaggagggtattgttaatcggggtctggttcaataccttattgcgcctatatctgacaatatacggtaagcatttaaccacttgccaacggcagcagccagggctatatctcgcttaaatcccccaaagttggcctctgagcctcaaaaacgtcaccagatgggacccacagaagcgctgccgctctagctgtcatccctgtgcgcaagacactgcccggcgccttgggctggcgtccgctgtcagaaaagcggaactggggaaggagctcttggcccctaaccaacatggcctctctgaggcttcagactgagggcggcagcctacggatcacgtgagggaaatcgcgctcttctattggcttcctctgctggacggccaccgggacaataacccacgtgggccggccttaaagggcccgcggctgtctccgccgtagttctgccctcggtggccggggcccccgaaaggaaaggcggcgggcggggccgggcgctctcctggagccgcggtgagcgccgccggctgcgacgcgagcccagaggcggcggaccagagaggcgcgcgaggatcccgcgtggggccgcgggggcgcggggtcatggaggacagctccaccgggccccggctcggggcggcggccgaggcggccgaggcgcgagcgcaaccagggtacacgctgcggcccttcgcggctttctcgggggcggccgggcccgacgagggcggcagcgactggagcttcattgactgcgagatgatggaggaggtggacctgcaggacctgcccagcgccaccatcgcctgccacctggacccgcgcgtgttcgtggacggcctgtgccgggtgagggccgggcgcggcggcccgtcgggcggagggcggacacttgttgccgggacgaggcggcgccgaggtccggggccggcccggggcagcctcttcaagccgggtcgccggcggaagaacgcagcgatgtccccggctaccctgcctcggtccccctctgtcccggctgggttgggagcgccctccccgagatcccgggtcccctagcacctgccgggccgcgcgctgcccgcccaaggtggggatcttcataggggtttgcctttcacctaggctggctggtaaccacctcccagcgacgcccctgcccttcgcccccgggtgtgaactggggtgagttagaggggcgacatagcaggagacgatcggagcatgaattagctgcccagatggccggggatgcgcgtaccctcaccctgaggctggggtcgttccgggcactttacttaactcctttgaggaggggtcgcttcattcatagggaggaggaaacagacatttatccgcgcgtcgttgactcactatacataaataggaaggtgtctccgcattctcaatctgtacgcctaggaaggaaagccaatgtttgggtgaggagccgcggtggctctttatccagcgcttggccagttttggtcgaatggtgttggggggaaggggccatttgctaggccttgaggatagttagtctggaatcccgctccctgaaagggggtggggggcgggcaggggacagtcagtaaagggggaattggattttgttctctgtttttattttcccctccagatccccacattttagacacgttggagagtgagggggcaggtatgagtaacagatggtggtagggaggagggatttatttctgatctgcaatcaatgtgcagaataaaatgtgtacctcggccagcgttgcaggataaagtctgcctttgagagagatgccccattaggggagcagctatcaaagaaagtgctgctttcggatgcttggctctgagtccgcagttaactgtcagtgaactggagttgaaggcggctgccaagagggacaccattggaacagagaatggtgcccttaagacccatgtgtttatcaggtacaggcccatctactctcagaaaggatgtccagtgttatgtgcttagataagggtccatgcatggtttctaaagctacagttggcacaaatacagggtctaactccttttactctaaaaccttttctcttgaggctgaggtctgtcagcatatggagtctctttcttaccggttgtaggctgtcatgccaaaggagcaagattagatcatacaaaatgccgcttgtgtgcctagcagtctcatagttttgcagtcttccctgtgtcagagaccatcctcaaattgctgcatctgaaatgttgcccaccttgcaagctcttcactttaacaaatgggtagagattctgctttgagccaggcactcactgttctaggctctgagggcacagcagtgaagaaaagagccttcctgccttcaggactggcatttttgttgggaaaacaagacaataaacaaatatatatgaaataggtcaggaggtgatggtactataggaaaaaaattggccttaggagatggggaggggagatcgtttaccagaaaacgattggagaaaggctcactcacaaggtactgttttgagcagagacaccattcatttattcttttactgtttagcgaatgcttcctgtgcttcaggtgctgttttaggcctagtgtacagagtggcgaacatgatgagctttctgcttatgttctagcagaggctgaggaagggggagacagttttaaaaagggggtgcacaggtgggaatcaggctgatgtgatagggagtggccgaggagaggacagggaggccttgccaaccagagcctagcagggacactgcggtggttccggaggtgtaatgaagaaccggttggtgggggcaggactgaagcaatcagcagagagtgttggatggagggaagtcctgttgctgggaccttaggggaggaaccttctggcaggagctacagacatagagggatggaactgaggtggtgaagcagcgagctgcaggttaagaagtacctcagcttgccccagctttctgatctcatcattggcagaaccaagctggcagccaggaggctggggactccaagcaatgcagctggtaggtggggtcaggctcagagaaggtggagggggcagaacacagctctgggatcagtgccggtaaagaggacctgcagagagagcctgcagcccattttacaccgagtggccccagaaggccactctgcactgcttggatgtggctggcaggaagaagctcctcatgtagatgttgtgtggtgggcatccaggcagcgggcatagcagatgtgaaagttccagtgcagggatgaacgaaggcctttccagggcccagtgagggtggtggtggtggccgaggttggatgcagccaggggacggttctttgggagcctgggaagccctgggagggtttcgggtcctgttctaattaaaagctagctggagaatggctttggggaagaaggttgggtgggcaggagaggcagcaaggaggccccttgtgaggatcttagcttgggttgtcaggggagctggccaggtgtttgcactaggttggtggggttggaaaccttgctctcttctccattcggggctcaggagcctccgaatgtgggctgggggagctctgtgccttggttgcccatctacagggtccttcagaccactggagagccttccaggagaaagctagtctctcatttagccaacaccacccctccaggtgggaagatgtggcttctgagatttcagttggacaactttatcattttggaatgtcaccttggggtgctgtagtgaaaatgtgattctacttgaggtcggcagtgtctgacccttgagtaggcagactgttaactgtgttgcccacagaggtcccctttgtgctggtagtctggccacatgggtatctttacctagtctgttggagggtcacctgggtgagtgacagtgtcttaacccgttaaagctactgtaacaaaataccacagactggtggcttctaaacaacaggaacttatttcacacagttgtggaggccagcatggctggctgagggccctcttgtgggttgtaggcgcctcggtgccctcatgcggtggcaaggaggagacagctctgtggggtctcttacaagggcactaatcccattatgagggccccaccctcatgatccttaatgacctctcaatagctgataccatcatcttcgaggaggaggacatcaatctatgaatttggaggaaacaggcatccagagggtggcaggtgatgtgaaggaaaaaggctgtgtcagtgtttttcccatgtgttcatgtcattctctgaccttcatcttaaaggaaagaaagaaattgacctgaactatcagttcatttcctggtggcacagacagtaaagaaaccacctgcgatgcaggagattcagggttcaatccctgggtcgggaaggtcccctgaagaagggaatggcaacccactccagtattcttgcctggagaattccctggactgaggagactggcaggcgacagtccatggggttgcaaattgtcagacaggactgagcaactaacatcatttcattagcgagttaatattggaagcccattttctagctatcacagttggatctgatgtgtaaaatgtatttttgttagctggatcatcatccagtattgtaaattatttataatcaacatgttcattaattgtttatctaaaaaatgaagccatatcatcattaatttcaaataatattagtcacttcaagtaatatattagagagattcacaccattacaaataaatgaaaacttttattaaaataagattatttttctgttgtacaaatgtttgcttagcatattccactgccgtattctttttgtgaacctttttgctttttactgagaaagcagagctgtgctttgcaccagtaattacctgtgctttggattgttggcagcggttggctggttccctggaataagagttcagttagttgtcaccaagctaaccagaggtttagagttctcacataatattgttagtttccaggcagtagagatggttccatagagtaatggaaacgaacaccatgttgtctgagccatgaatgtatatttgatcgaaaggctaatttggataatgctaatcatagaaaaattcactctcctagtgaataaactcacctttcttaaaacaaatgcccatgtaagatttgtgatactgccatgctgctgctgctgctgctaagtcacctcagtcatgtctgactctgtgcgaccccatagatggaagcccaccaggctgctctgtccctgggattctcaaggcaagaacactggagtgggttgccatttccttctccaatgcatgaaagtgaaaagtcaaagtgaagttgctcagtcgtgtccgactctgtgcgaccccatggactgtagcccaccaggctcctctgtccatgggatcttccaggaaagaggactggactgggttgccattgccttctccggatactgccataactttcctttaaaaacatgaaatatcctgatggtcatgaaaggagttggagtggtgtccttaaattctttttattagtgaaagcccctgagcagctcgcgaaacgcctgtgcccaagcccctccagaccaactccagtctcatcctgggagtcttggcctgggagactccccaaggtggttctaattgggagacaagattgaggatcattgtctagccaaaaggggtctagcctgaccagaatcgttgtcatatcatgaacatatccttgagtcattgatcactggttccactctcagccagatctgtgcttggtctcctccagtccaaaatgagagtcagggccatgctctggggcctcccttctcctaagcgccatttgatctcgtggctgtaaagcagggtgactggtcatcagcccgagagcccagcctttgggacaaggagcccagcctttgggacaagaacaagaacacctccttgaacatgggcttgccttgcctggccgccgtcctcatccacttgtgctgctcctcgctctcctgctgctgctaagtcgcttcagtcgtgtccgactccgtgcgaccccatagagggcagcccaccaggctcctctgtccacaggattctctccaccagacatcagatcccagacttgtcctcccaaagcctgtagtttggtagtaaacaagttatcactcagcagtgatctgatgattgaaacgttggggagatcccaagtggcacagctgaagtgcgtggtttccacttgtgcggctgttatgtgcttggccatgtagctgtctgtgcctgtcccgagtcagtttgtggcagcgtgctgtcaaatgtgacactccggaagcagagttgacagttgggctccgttgcagtgtggcacccccacctgcacagaccattggcacttctcagcctagtgtcatcggctttctcagacttgaaccgacctcacctttccccgtaaacctcctcaagtgtggagagatcttaagccaatatggtatgctttagtttatttgggaaagttcagaatgttctaagtttaagaaaagcccgcctattacatacgtgcaaagtttacagttatccaccgtttccctaatttcagaatttctggctcatgtataaacaaacagagagtatattaacatccacaaggttcttttgatctctcctccctgttcccctccctcgcaagcattcgatccccttttcagctcaacccgtcagcacccttcattcagtgctcaaagcacgtcttcttcagtgcagtcgttttcaggactcttgtcagcaactacagacatttcaagccccaagacaattacgtaagagaaccggaaaaaaaaaaaggctttgtgatagaacagctaaagcagaggctgtttgattccagtgtttatatttcaggctctactccttttaaaaaggccagcagatgacacggtccattctttttgcctacaggccaccccctgttctgtgccggcccctctcctgtcacggtgatggtgcttgtgcacgtcagtgtgtgttgggggtgggctggggagtcgcctcctcggtgtatgttttctgcacacaattgttaggacccgtttcaagggctgaggagtgctagtcattcaaaatacaatttagttgcgacagagaattttgtcctttgtaaatactaatcagcacatggagacgctggcacttaatgaaactgtaagtgactctgctctgtcctctgagctgctgctgctgctgctaagttacttcagtcgtgtccaactctgtgtgaccccatagacagtagcccaccaggctcccctgtccctgggattctccaggcaagaacactggagtgggttgccatttccttctccagtgcatgaaagtgaaaagtgaaagggaagtcgctctgagcagtgatgggctctaccatggccataccagagtgggttgccattcccttcttcaggggaatcttcctgatccagggatcgaacctataatactataaaagaatgcgattttagactccactacttaatgtaagtaaaatacctgattgatatgtttacagcaacagctgtcagtccatatacttctgaactgaatgttcaggaaactaaagctttttttttttaaacattgggaaggctcagtacttttcctttcattactgatttcagcaggtgcaatatgtagttcccatgtgtaatcataattaacaccagagaacaaggtgtttgaggttggcctgaattcagaattaaaagacaaaaatgttattggattcagaaagctaatattggagttttttttttttttttttaattcaacaatagcttgttttactttgtcacctttatcatttttgttaaattttctgctttaccttactgataataaaatagtttctgttcatttacgtgaattgctttctgtgtaatatataccatttcatcattttacaagaactctgtgaaattggtactattattcccattctacagatgtgaaaactgaggccaggagaggccaagtaacctgtcccaggtcacatagtaagtgctggccctgtgatgcaaacctgctttcgtgttaattgctcaatcatttcagactctttgcgaccccatggactgtagctcaccaaactcctgtccatggaattctccaggcaagaatactggaatagatcccctttttcaggggatcttcctggcccagggatcaaatcccagtctcctacattgcacaaaactggttttagccaactccaaagcctgttctgcaatcatcttacagtatgcagtaatgcacgtgaatttttcatatctttcacatcttatttcatccctaggatagctctatgagtaaagttcttttatccacaggaaactgaggttccgatgaattacaactctattattctctcagccatttatgtttaacagatatatttgagtgcttttggtacatcagttgcagccctgatgacattcatgggttcaagcagaaggcagtacctgggtgctggagccagacagacctggatttaaatcctggctccatcacttcactcatttattcattcattcaactcattcactccttccttcagtcattcattcattcactcgttcaacaagtatttttttaggtaatatattgtttgaattttatttttattattgtcattgagtttatacattttaatacattaaaaaaatttttttgaatgtagtaatacattcacattgttcaaaacccagaaagtattaaaaggtatatagtgaaaagtctttctccaatcttgatagccagtcctctaaaaattaactatgatttttggtaaattttctgcttccagagtttctatatgcatatttgaatataacataggtatttcactagactttcatctctttccccttgacacactaaagttgcatatttgcttactgttctgtatctttatgttttccccacataacggtatagctcggagatgtttctataatggtacacagaaaggtctcattttttcctgctgcatagtattccattgcacacatactatactttgtttaaccagcccctattggtagatatttggtttgtttccttatttttcctgttacacatgacttttccatgagtcacttcagatgggtggcagagaattcgtctagtcaaagggcatattcattttaacacgtgtttctcagggcctgctgtgttctgagcactgtgctggtggcagggccctctataggaccctagatgagtcagtcaacctccccaggcccccagtctgcccagttgcagaaggaggacagtaacctcccccccccccatagtctcggtgaggtcagtgtgagaggtcacagccctcggtgaatgacagacagcagccttcctcctggtgctcacaggccagcaagggaggacacgtgattgttttttttaattgtatatgctatgtaagtcggagaaggtgatggcaccccactccagtgctcttgcctggaaaaccccatggacggaggggcctggtaggctgcagtccatggggtcgctaagagtcagacacgactgagcgacttcactttcattttttcactttcatgcatcggagaaggaaatggcaacccactccagtgttcttgcctggagaatcccaggggtaggagagccttgtgggctgacgtctatggggtcacccagagtcggacatgactgaagtgacttagcagcagcagcatgctatgtaaatacagcctaagggcttcatgggcttcccagatgactcagtagtaaagaatctgccttccagtgcaggagatgttggttcgatccctgggtcaggaagatcccctggagaaggaaatggcaacccactccattatccttgcctggagaatcccatggagagacgagcgtggcgggctacagcccatgtgctcgcaaagagctgggcacaactgagcacacgtacacacacacacgtgcaagggcttaacagatccataacaaaccacctgcccttgggcaagatgtccacccagacctccgccgcttcatctatgaagtgagcaggttgagctggatcagctcagtgaggttgcttccagctcttccgttggtggagtgcggcccctttgccccttgctgccccatagggtttccccagcaggaactggctcagcaacagaatgttccctagtgtgaccgtgactctacttctcttccatctggctttccagcctcgcgcctgtaggggagacagaaccctgcctctgcctgtcctaggttttcagctgtgactctttaagaaaaagatggatttcaagagaaaaacagttattaatgagtgcagcatgcatcaggggggagaaccctcagcacgacaacgtagagacttagaactcggcttgtacagcctcttcaacaaagaataaattgataagagaaacggtaggagggagggaagccgtttcaggcttccagctcactgcagggaagtcagttcatgggaggaagctgatgggcacgttggcacactcctccatgagagtctggaacatctccattaagagggtcatttatgtcctaccttcaggcaggaaagagagggaagatggaggtttccggcatatgtgtttcgtaactgccttcagctccaaataacttttatgttgaagaggcatacttagggggtgacattctggcttccccatccccacactcctgccttaccctgcagtggtccctgggaagcctgtctgccggtttgtggaagagagaaggtcaatttcagtcacttaaggcttgtgtctgtaattggtcttggaaatttcattgctccaagaggaacctgtgtcagagacactctacttgaccccacagccaattctgtccagttgccatttgagagtttgccaaaggtttatccttacaaagccagaacacttgagtggaacttttctttttttaaaagtttgtccattactaggggcttttccagatcccctgatagtcatttattattgacagggtgaccgtatgctccagtttgcccatctcgtcccaggaaggttactagtagtcccttctttcatctgaagtttgagtgatctattatatacgtacttagtaattatacagtttgtgataaacaccctgttagtgcttactgttggccaaatattttatgtacatcattaaatttcatccttcttgagcctagttactcagttgtgtctgactctttgcagccctatgtcctgtagccttccaggcttctctgtttgtgggattctccaggcaagaatactggagtggatagccatccctttctccaggggaatcttcccaacccaacattgcaggcggattctttactgtctgagccaccagggaagcctactcatccttcttacaaccttctgtgatcgatactgtatttgcccattttatagatgacaacatctttctgctgcctttgtgaagcttaatcagcacatagaatcctgtggcaactgggcatcagattctgggcacagctacagaaccatggcagaaagaaccttgggctcaagctttcttcatttctgcagggaggaatcaaggctcagagaggtgctgaggtttcctaagggggaactcactacatactggcagaactagaattttctcccagcctgccagttacaacgcttgtctgatttcctgtgcagtgatgtcctcccctgctccatcccccagctctcactgagcacgcagagctgttgtttagtcggctgagtcatgtcagaatcttttgtgaccccctggagtgtagtccgccaggctcctctgttccatgggattttccaggcacaaatatgggagtgggttgccacctcctgcttcagggggcacccagggtatgtggataatgaggtggacatccagagtctcatcagcaggaacaagaagaactgtcaccgcgccaccgttaggggcccccaaagagcaaggtatctgtggccggtcctggtggagggacagaggagatggtgtcctgagaactagtccctgggctgttcgaacaccagtgcccaccaccagggggaggtcacctcacataagttctgccatagagactggtggttgccttagactttgtttctggcatcaaagattgaaagtgcattttcagagggggaactccctccttgtgctgcagaagaagctatcgtaatcatcggtgtgtaattgaaagctggccaggggaggagaccctccctgctgctgggcaatgggaccccctttggttccaacagggaacaaggatgctgtgcctcaaggagtgaccctcctcttccagctgccccgagtacacgctgtgacgtcctccgccccctcctctgatctgtggttacttgttcagacggtgactcaaactatcagcgtaaagaaatacaaagagagctcactcagatgaagcaggcacttcactgcaaagataagggcaattttctgagctggcttctgccattaggttgctacagagattcattttcaaagcaaagctcgagctgctgcataggttgccagacccctgtggtgacccctgtcctccgaggaattatctgctgcccaggcgacagggtgacagtattgttctgggctgaagtcaggatttgggacagtttgggtagatctcagctctgctcactcaaccacctttccatcctaaggtgcagatctcagatggtgatggagaaccctcaggtcggagtcagctgttgttgttcagtcgctaagtcgtgtccaactctttgtgaccccatggactgcagcatgccatgtttccctgtctttcactgtctccaagagtttgctcagactcacgtccattgcgtctgtgatgccatccaaccatctcatcctctatcacccagttctcctgccctcaatcttgcccagcatcagggtcttttccagtgcgtcggctcttcccatcaggtggccagagtattggagttcagtttcagcatcaatccttccagtgagtattcagggttgatttccctttgggttgactggtttgatctccttgctgttcaagggactctcaagaatcgtctccagcatcacagttcgaaagcatcaattcttcagcactcagccttctttatggtccaactgactgtaaactcctaaaaacagaccactcaccagcaaaactcactgggttacagttcatgaactggccaggaaacccttgcagacgtctggcaacatctctccctctctggaacagccccagtgtagatatatccttcaaacttaaccacctgtttgaccctgacacagcatttccggagctgttctcatgttttacatcaactctgaatttgtgtatttcttcccaatgatttataggttttcagggcacgcttggaccccagtgtgttctgttacttgtaatttccttgatataacttgggaaataccatcattgaatggtcaggaagtctgtaacctccacgttcagagtagtcccattatttggaacacatttaagataatgacctagttctcactactgtgaacatgcctgagacagtggcatagatgagttggctgggcgtagagaggttatatgtttggggggtgacttcctacatttattggagggtagctagctatgcagaggaccaaacagagtccaatgtgcgtatatccgtggcttggaatgaagcaataacagccagcctgtggctgagattgtgagcacattctttatcttatatcgtaaaacaagggctgggtgatcctttaccctactaggatacggtgagaatgaaatacagcaaggccatgtttgtgataatacttgaagacagaacataccctgaaatgatctatttagtctttatcaaggactttattacttactttatgatagaggttttgtattgaatcagttcagttcagttcagttggtcagtcgtgtgcaactctttgcgaccccatggactgcagcacgccaggcctccctgtctatcaccaattcctggagcttactcaaactcatgtccattgagtcggtgatgccaatgtattgaatagccatttcatttttatttcattttcctttcttttcctcctctgttttctctcctagacagcacagggaccacactggcaggatcacctacttgcaggctttcttcttgcctgttgttcactttattttaatggcttagcccagagtgaaagtgtgtaaaagagaatgcacgcattaccccgagaatgcccaccttctttatggacaaatgcctatgttcctttagggcttctctggtagctcagtggtaaagaatcctcctgccaatgcaggagacacaggttcaatccctgggtcgggaagatcccctggagaaagaaatggcaccccactccaatattcttgcccgggaaatcccatggacagaagagcctgctgggctgcagtccacggggtcgcaaaagagtcgggcatgacaacaacctactttactttggtgttgtgtgtgttaaaaaaaaccacgaagagtcagacacaattgagcaactgagcacagcacgacatgttacagaagcagtaagattcagtagttacaagggtggactccagagtaagtaggtctgaattgtgagaacttggtcaaggaagttatcttccccgtgcttcagtccctttgtgaaatggggtaataaaaatataagatgaaaagagcatataaataaagggctaagaataataccttctaactgttagcagttttatttcaatgattactaaaatgcaaagactattgtatctgagattgctcactgctgtaaccctgtgcccaggacagtgtctgccaccaggtctcctgcattgcaggcagacgctttaccctctgagccaccagggaagccccaataaatatttgtgcagcagtgaaaataagacattaacattataaggaaagtattgctcttttaagttcattaaatgttaagccttattttcccaggagtaattttaggcacctccagatgctgcctacattatcttagcccagtagactctgctgggcttcccaggtagctcagtggtaaagaatctgccttccatgcaggagactcaagttcgatccctgggtcaggaagatcccctggagtaggaaatagcaacccactccagtattcttgcccggaaaattccatggatcgaggagcctggcaggctacagtccacggggtctcagagagtcagacatgactgagcagactgagcacagaggctctgcagctttaaaattgttgcacgcgcacgtgtgcatgtgcttgtgtgtgtgcatacacacccacgcctgtatgaaattgacaagcttaggttttcctcaacatttaggctactgttctgaaatgtattacaccagaagactaccctggcttgttatcacttgtaatgcttaggaaactatgttttaacgtgaatgagtgtcgccacaatgttgaaaacaaagaaaactataaacacttaaaaaaataagtcagtaagatactggacataaaaaccatcaattttatctgaaacaaaatcattgatgatgaaaagaaatcctaggcttctccacacacacacatacaatcctgtaattgcaaaatatattgtcatctttgctggtgaggttttcccccctcccaccatccctcccttcttctttctctctttctctctgcttccctcccctcccttctctctccttgttcatagaatgcctttttgaggacacatagatcttttcagaaattcattgtcatctgctgaatcccatgtgctagccagcctctggcctccttgatagaagggagcaggtcattctttgccaagtctcgtccgaagggggcaaagtcaacttgtgagcttcttatctctgaacgctgctgccctggtttccatcagattgtgccaggaaagatgaccttccttaatgaaatgcatgctgtctgcttagtactcagaagcctgctgtgcttttaattaaatgaaccagtctttaaaaacttgagtcttatccccggagcagcatggcacccacagtctgtccccaggtcagccgttccagatggttacgtcatagagcggcacccgtggggactgaagattggatcgaagggctgtagcatggtgtgatctgggctcatagttcttggagcgctttctttgtgctttcagtccaggataactcggccttcatccagcattccagtcagactttagcaagaagttactcaccattgtatttatgtctacacctgtgcccgggtgttgttgttcagttgctaaggcgtgtctcactctttgcccctgccccctgcccccgtggactgcagaatgtcaggcttccctgtcctttaccatctcctggagtttgcttagactcatgtccatcgagtcagtgatgccatccaaccatctcatcctctgtcatccccttctcttcccaccttcaatctttcccagcatcagggtcttttccaatgagtcagttctttgcatcagttctttgtgctttgaagactgctgctgctaagtcacttcagtcgtgtccaactctgtgtgaccccatagacggcagcccaccaggctcccccgtccctagatttctcaaggcaagaacactggactgggttgccatttccttctccaatgcatgaaagtgaaaagtgaaagtgaagtcgctcagtcatgtctgaccctcagcgaccccatggactgcagccttccaggctcctccttccatgggattttccaggcaatagtactggagtggggtgccagattaattctttataaaatttacatttggtcattaaaagcattaattgaaaatatctcatccttttctctcattctgtttcttagaaataacctctaggttttattgtactctttcgtatatagtctatatacaccatgtgcatgtatttataaatatcatattatatacactcttttgctgcttgctttcttaaaatattggacatctttcaatagactcaatgcatttcttttgataactgccatttcttagtaagaatgcaatgtaatttaaccagcaattcttttttctttttttgttagacttttggccatgccatgtggcctgaccaaggatcaaacccatgccccctgcagtgagagttcggagtcttagccgctagagccctcaggaagtcccagcagttcctactgatagacatttagtttgtttctaggttggatgttttgtttttgttttttcttattatgaggagcatccttacacagacctccctgagtgtccaagggggacccattccaggacgtacggttaccaaaatctacagaagctcgagtctcttatggtaaatgacatcatatttgcacgtaaccttcgcagtttacatgctctgtgcatgcgtgcatacttagtcgctcagtcgtgtccaactctttgcaaccctttggactgtagctcgccaggctcctcattccatgagattctgatgagaataaggagagtactggggtgggttgctcttttcttcttcaggggatcttccaacccaggggtcgaacctgggtctcctgcactggcaggaggattctttaccctctgagccaccaggaaagcccctataaagaatgaaaccaaaacgcaacgaccaaaccttgttggtattttgagtgattcctttgggttgatagttactttgggataattgacatctttatatattatgttgttataatgttgtactgggcttcacggatggctcagatggtaaagaatctgtctgcaatgcgggagacccaggttcgatccctgggttgggaagatcccctggaggacgaaatggcaccccactccactattcttgcctaagaattccatggacaggaagcctggcaggctacagtccatggggttgacagagtgactgacacacagtgttgttctacttcccgaagccgtcttttatgccatacgtgcaggtttggcattttccatatgcatgtatatgttcttcacatagagcgcctatatatttctttagtttgtttttatgttttaggtttttcagtgtaaatattttcatgtaagcgtaagaaatatattaaaatatgagatctccttttccattatacttccttttcctttcatgtaaagggattgttgtttcctgcatattgattttgtaaccatctgccatactaaagcctcttatggtttcttctgcattttgcaggtgttaaatcacatcatctgcaaatagtgacagtcttgccatcctcttcataatacttgtgttttattctcttatccacacggcacttagacactagattacaggagcagcaggtgtcatctttgtcttgtggccagctcttgtgggaaatgtgctggtgttccaccattgaccttaaccttggccaggcagtgtggtattttaactcacctctggtatctctgacaaatacttgcctgtcctagacctggttacacgcaacagacacacccagctgtctcattgcttttctcttacctagcactcagttctccttctaaagaagtgacttcagccttttggccaaagtcaacatcttccagtagttcaccagactgaccaacaatgcaaaggagaagaggaaaggcaccagctttgtgttctctaggtctcttagaaaacatggatccgttcctttggccacacatgtgccagtttacaaaaaaggtaatattgtagacatcagggaacttgatacttgtgggcactgttgacaatggagtgcccccaactgttcccacggcaagactggaagaacccacagtgtgacctggcgcactgttgggattgtggcaaacaagcaagctatgggtatggttcctaccaggacaatttatgcccacactgagcatattaggcttcctaagagtctagatagcttcctgaaacatgggaagggaaatgactggaaaaagaagaaagccaaaggggaaggtacttgggttcaactgaagctccagctggttccacccggagaaacacactttgtagaaacctgcaaaaaaggagcttgagctgcaggaacctatttgctatgaattcatggcttaataggtgtaaaaaaataaaggtctctggactataaaaaacaaagaaaaagaagtgacttcaagaacattaaaagcatttttattgtagtattgttgatgtacaatattatgtaagtgtacaatgtagtgattcacaatttttgatgattatactccagttgtacttactataaaatattgtaatttttcatgttgtattcctatatttctgtattcctcatgttgtccaatatatcctcatagcttattacttttacacacaatagtttgtgcctcttaatcccctattcctttattgcttctgcctctgtccctctccccgctgtaaccactagtttgttctctatctgggatcggtttccgttttgttatattcactagtttaactttcagattccacatgtaagtgatacacaagtatttctgtctgacttaattcacttagtgctaagtgacttaccctgcgagttcatctgtgttgttgcagatggcaaaaatttccttcctttttatggctgagtagtattctgttgtatacacacgcaccacatctttcaagaacactctctgaaccctgtgtctctgtctgcacagtctggatgctgctgatggagcgccctgtgttgatggaaatcttccgtgtctgctctgtcccacgtgatagccgctgagcatttgagacgtgggtgtgcctgtgaagctaaattttatttcatttaaattaattaatttaattaaaattaatttaaatcatgatcaactattgagcacttaaaatgcagctagtgctgctaaggaactgagttcttaattttgcataagtttatttttttattttttttatgttaagactatgctgcatggcacatgggttcctagttcctcgaccggagattgaacctgtgctccttgcagtggaagcacagggtcttaatgacgggaccaccagggaagtcccttagtttagttgaaatagccacatgtagctattagctccagcactgggcagcactggctcttcagccctaaataacatgaaagcctaggacgtgaacacagaaaggacctggcggctcccgctgtgcccagagaggtggaggctggcctcacatcctcgcacggcaagttcatgattaaacagaagaagccaggctccctcttcttgtctctggcttttctcactgtgcttgaccctcctcttaactcctcacttcccacgtcccttcttcaaatgacagccgaagtccaggtgtgtaccaacttacgcacctttgataaacacgtcttaacccactgacttctccactaagtctggagaagtctggctttggggctggtgcagatgtagaattttcagctgtgtggtcttgccctgcagggccaaggctctcttgtgagaagggcaggtgcagtgggtccaggcgttgtgtctgccctctctgccagtgggatcagaatatccttaaacacctgaggatgtctaagatgctccagcatcctcaggaacactcgttctgtgccctttcagttcaccttgtcttctggtcccatccttaaacgactgtaaacatcggtgcttccagcatgacagcagggcattgcttcttgccccttggctaatctaaaccttaagagaactcaggtcctgcaagtcagggagggggataaagaaagcagagccttagagaaggccctcaactggggacaccagggtagagggaggaccctgagtcttgaaggaccccacggccttgctcttgaggcccttggaattcttcccgcctctgccagccttttcttttccctgggggttcctggtcagtcactcaggctcactgctggggtcctccttagatggcccctctagccactcttcaacagaggcaggagggacccacccaggaaggaactctttaaaaaaaaaaaaaattgttgacatagttgatttacagtgatgtgttagtttcaggtatatagcaaagtgaatcatattatattatatacaaagctatatatattatatacatacatggaagtggcagtttagtcactaagtcatgtctgactcttgcaaccccttcgactgtagcccaccacactcctctgtccatggaatttcccaggcaagaatcttggagtgggttgccatttcctcctccaggggatcttcccgacccagagatcaaaccccatgtgtcctatattacaggcagattcttttattttttttagaaaagttggttcactcatttattcctgtagatcgtaaactgccaatattttaaaactatctgattaggtttccaagaacaaatctgagacatcccatgtatcacaacctttcctaaatatagcacagagacttcaatttcttgtaaaacaatggttcaccaaaaggagccatcaagtgtccatttaactaaattttgctttgctatattaaaacataccagaatttttctacttttgtcatttggttgggaaggttgttgatagtgataaaaatttcccttccagggtttctgcatataaaactgcatttatatgcagatatggatgcagattctgatagggatgctttaaaaaattaccgaatttaaactccttaatttgtctaattaattacaaaattatttaacttgaaaggttaagacttaaattttcaatctaagttgaagttatttcttatattgctcaaaatgatgtaattccagaacatgggcttattcatggttatgaaaggctgttgtttaaatatatttaccaaaacaaaaaccacaacaaaaaattaactcccaaaccatttacatatgtcttttatgtatacacatataaaaaacttagaatggtcctcaggcatatgtgagttaaatgcaaattctaaattctgattgagtaatgactatggagatttcctccaacatttagaaaaactgttctgtaatgctgaggaaataatataccatggtatcaaattctttcctactgaaggaggcaactacagaaagcttttatttgttcaaagtaaccagtgctacagatggaaaaaacaaaaaaaacaaaaaacccaatgtaacttccccaatattacttcaaagcaaacatatcaaacctgattttcattcagttcagttcagttcagttcagtcgctcagcagtgtccgactctttgcgaccccatgaatcgcattagaatgtagttatttcttcacactaataaataaaaaaaccaagacccacattttatatatatatatatatatatatatataaaaaggcaatgcagacaattattgagcctcatcttctggacaagaatgccaagttagtctctcttcataaaaagcaattacaatttgaggacacttcatatttgcctcttttgccagtaccaagtctgcctcatcagaatctttccatttcatgaggaacattaattctccactgccgtctgtggcaccaattattcgttctggatcaagacctctgaccaaacctctcggtttatcagcagcatctcttttctttgatttgctatcatgagattcactgtcagacaaagattttctttttgttccatctttttctttaccagctttttgaggattaaatgcttcagttaactctggacaatctaaattttcttcaggttcccaaatactgtctgcatctgtaaaccccttccacttaaggaaatactccgccttcccgttcacgacacggtggtccagtactttttctactacaaattcttcaggttctgcctcttcaactattttactctttccattttgcttctttcccattttttgcaatgtagttttattggaggccatattttaaattgcagacttgaagagctattattcactgcctctgagctgctccaggtcccgggtctgcggtgtctccgggtctgcggtgtctccggccctgcgagcctcaagctccaatcacacccgaggggctacaggtggattctttaccgctgagcccccggggaagcccatacatacacatatatctactctttttttttttcttagattcttttctcatataggccattacagagtattgagtagcgttccctgtgctctatagcaggtccttattaggtacctcctttatttgtagtagtgtgtacgtgttgatcccaaatgttccaatttatttctccctgcccctttactgggcttccccctggtggctcagacagtaaagagtcgcctgcaatgtgggagacctgggttcgatctctgggttgggaagatcccctggagaagggaaaggctacccactccagtattctgacctggagaatttcatgaactgtgtatagtccatggggtcgcaaagagtcagacacaactgagcgactttcccttcacatgtatatatattatcatcttagaaaggcttccctggtggctcagctggtaaaaaatcctcctgcaaatgtgggagacctgggttcgatccctgggttgggaagatcccctggagaagggaaaggccacccactccaatattctggcctggagagttccatggactgtatagtcttggggtcactggaaggaattctcccctttctctggtcatggtcagcttagccgttaagagtgcaggactacctggggtccagcccagctccgcccctccttccacgaggccgggccacgctccacccggtctgtgcctcgacttgcctgcctggagaatgggggtggtcaccctcagggcccctcccagggatcccagtgaggagcgtgtgagtccctagatggagcaaactcagagggcctgccttgccaggacgccctccacagaaagacatgacagctgtccccatcctgagggcaggtgacacccccccaggcccggtcctcctctgcccctcagggaagctctagatgccgacagatttggggagcgctgcctggatgtacatggatggctgaaccccgtggctcctttcctggttgcatcacacatacaacccggcttggcagaggggttggctggtgtatttgaccgtgggtcccaggccccttggggtggtttgtcctgcccccatgacccccgttggagttgttggggtgtcagctcctcaggcgggaggagggcctgcctcccggaagcctgatcacacccccccaccatgtttctctttcttggcccaggcttccatggtggctccgatgacggcacccacccgcagagcctggcccccacatgctggaatttgtgatgaatacatggcttgtgtacactgatcgcagagtcagtaatttgctaaaaggtcaaactcagcttgatcagaacacagcatatctaggattctagtccttctgtggatgttgatacattttttttcccccatgatcagggaaaaatcttggagaactctcttaaaatctgggtaacttttcctccctctgggatgatcttttcccctgcctctcagcaccatccagagaagggaaatggagctccagtgacttgagctccactgtctatgcagcacctactctatgccaatgcccagggcaaggggcacacctgggggcgctgaagcaaatgcttgtgtggtgtgtattccatgccaggcgctgtcgtacatgcttagcaacatggatggatttcatcctcacacagacccaggcgggagatgctgttcttgttcccatttgatggatgcagttgctgaggccaaggagcctgctcatcactgcacagctaagttggggtgggggcaggacttgaacccagagtctgggttcttaaccactccccccttaccctgactgcctgtccgctctggttcctcactttggctaaagccagcatccctgggtagtagtcacttgctgtgagtactttttttgtgtgaagatgctgaggcctggagagtcagtgtacaggccagtagcctgcctggggttcggacaccacacccaacgccctgactgcaaagcccactcctccctggcgcctagaggctttgccagtcccagcccctgggccctgccctcctgccccttcacatcacccatcaagccgagtgacttcaaggggctccaggctctcctaaagggagtgcctctccgctcctctatcccacagaacattctcatattctttctttttttctttagccgcatctctgactacaaaattgttctgtctcccacacgtgtgttggctggtcatgtttcctctagcttattgcctctggacagctcttatcgtttgcctgttcagctgctggactgtttgttttaggcaggcccactgtccgactcaagggtcaggaccgaaattcacctgagtccatcagttgatacataacatctctgcccctcttctggcctgcagtgactctgaaaacaatcacgtgtccttggcgctgagtaaggggatgagaaggtagaccatgtccatcccccagccatccagcctcaatcaaaaaccaagggtaggaacttccctggtggtgcagtggttcagactccatgcttctactgcatggagtgcaggttcaatcgctggttggggagctaagattctgtattccacgtggtgcagccaaaaaaaaggcaacaacaagcaaaaaaacaagtgtagagtggcagtgttttccttgcatggagggcgaggctgcacctggttcctcctgtctggggcctggcgtgcaggaaccttccacaggcatccatcaaggggacaactgggcagctcccatgtattagatgggaagacccaggaaaacagaaacttcccagaacttctacaagagagaacacccacagcagttttcttcacggtttcccagacatttccccatttctgtattcactgaaccctatcttctgttctgaaaaccatgcacacctgttctctgggtacatctcactgaggcccagttcctccagtctctgggaggctctgtgtccatgcctacaaaacccacacagttattccagttcaggccgcctctccccgcatcccttgtctaagagaaaagccaagtggattcacgcacgaggaccttcccatctatacaagagagcagtaacaccagcttgcttagcatcccttcagaacttccctgaaaggaagctcgtgatttgaggtcgctcctcagcccatgtcaccagctgaatattattcgtaataagtgttttataatctgtgatgatgcatccagggatctgtccagcgagggtgagctttgcatgtggtaaacacaggttgtgccttgtccaatagccataggcactctgcaagcacacagttgacgggtggagggttcattcgctttgtgtcgaaacacacgaaatcgccagtatctgagcatttttttaaaatctaaaattgttgatgtcacacctccctctaggatcaggtttctcatatgaaaccgtctcagtgaccttctctgaaactggagcaggatcgaggtcctcatatgaagacccggtccatataaactcgagttacgttttattgaaatctaggtgagggaaaatttagctcattttggagagaaggccagcgcatccagccctgtcacgtgactgtgtttgtgggccccctgtgtgccgaaggcccctctgcttagaacccagggctcgatcctgtcttcatgctcctgtaaagtgtgtgctcagtccctcagtctgtctgactctttccagccccatggacggtagcccaccaggctcctctgtccacgggattctccaggcaagaatactggagtgggttgtcatttcctcctccaggggatcttactggcccagggatcgaacctgcatctcctgcgttggcaggcgggttatttaaccactagggccaccagggaagccgctcttcatgctcccagatgcccttaaaaggagcagcaccacggccccttcccaggtcttcctggctcccagtcaagtcaggccagtgaggttttcctgcgattgaagactgacgttgcctagtgatcgctaagtgcatagaagtcacataggaaaaattggtcagggacaagacagcctcagcccagagaacattcctacttgggatcaggaaacacaaggacgagacgattgggttgggttctgttcactttttaaggctctggatggccccagaaagacagctcagatagaaaaagctggttggggatctggtggatgggtgtgggaacaaactgtcccactgtgttgaaagtgaagtcgctcagtcgtgtctgactctttgcgaccccacagactgcatcccatgggattctccagacgagtactggagtaggttgcaatttccttctccaggggatcttcctgacccgggtctcctgcactgcaggcagattctttaccatctgtgccacccgcacccccccagcattgtgttgacctgccaactaatcctggagctgggaaaatgggacttacccctcccctcccccccaccccaaatgttcatcaccttctaatgcggtgttgcatgcagaagaacagcagcctaaagactgatccttgggttttatcaaatctttttttagcccctcaatcgggggacagtgccagctgggtgtggccatgtgcttgggtattatcagttcagttcagttcagtcactcagttgcaaccccatggactgcagcacaccaggcctccctgtccatcaccaactcctggagcttacttaaactcatgtccattgagtcagtgatgtcatctaaccatctcatcctctgtcatccccttctcctcccacctttaatctttccctgcatcagggtcttttcaaatgagtcagctcttcccatcaggtggccaaagtactggaatttcagcttcagcatcagtccttccagtgactatttagaactgatctcctataggatggactggttggatctccttgctgtccaagggactctcaagagtcttttccaacaccacagttcaaaagcatcaattcttcagcactcagctttctctatagtccaactctcgtatccatacatgactactggaaaaatcatagcctgactagatggacctttgttggcaaagcaatgtctctgctttttaatatgctgtctaggctggtcataaatttcctgccaaggagtaagtgtcttttaatttcatggctgcagtcagcatctgcagtgatttgggagcccaaaaaaataaagtcagccactgtttccccatctatttgccatgaagtgatgggaccggatgccatgatcttagttttctgaatgttgagctttaagccatcaccctgcactaatgaaggtggggcttcttggggagggaagcccgtgctgagtggctgagtgggagagagctacctgcaggtggggctggcaggggtggggtcctggctcctcctgacacccaggtgccatgccagcctggcattttgtcccacctccctccgtgcccaccccggtccctggcccccataagcagcacttctcttctggatgaaagttgagacatttgggtgaactgggttgtttttctcgggtttcccgactccccatcatttttctttcatctgttgacacaggaagattaggtcaggatgatgagctctgaaagcctggcagagggagcaagggggtcagagagagtgttccccactcttgatggtatttttacatctagattcctggtctgctgcagcttgctgtgtaaaccacctgtgttgtagtgggggtgaaggggagcaggtgggttagatgagatggtggctttttctaccaacttgtgtccactgagggccatttgggttttcattaaagaccctgatgctgggaaagattgagggcaggaggagaaggggacaacagaggataagatggttggacggcatcaccgagtcaacggacatgagtttgagtaactgggagtttgtgatggacagggaggcctggcatgctgtgctccatggggttgtgaagagtcggacacgactgagcgagtgaactgaactgacctgacctgaccatcgttaagatccaagttgtgggatcttgaaccctttaagtagattaattaactgaattggaattcagcagcatttaaatgacttaaaactctgtttggtctccaagtagtttgtgtttgaagctcaactttgatttccatccctttcttcacaccctccagggttcctcttgtcccccgcatccaggggcgtccctgcgttgaccggtccatctctgctgctccatgggtcaccaggtctttgctctcgctcttccctcctcttggaggagttttcttccagaaagcacagctggcttctcacgtcctctgggtcttggcttacctgtcatcatctcagagagcaggtccctgtccatcctatttcaactgcacaacccccggccctgcacatcttctgttcccctcacttggttgtcttttgtcctgcttctcactcgccatgtgtcttacttattattatcatctacttcttcctacctgcctgtgaactgcgcgtggatggaggtttgttgcaggtggttcaccactatgtctgtgtcccttgctcctagagagctgtgcaaggtacactgtaggtgcctacatcagtacatatcaaatgaggaaaggaatcctccagacagatttcctctgcctggtgtcggctgggcagcgtccaggaggtaagccctgggctcgactcactattgataccctgcgcatcgtaaggagcttccctggtggctcagatggtgaaaggtcttcctgaagtgcaggagacctgggttcaatcccttggttggtaagatcccctggaggagggaatggcagcccactccagtattcttgcctggaaaatcccatggacagaggagcctggtgggctacagtccatggggtcgcaaagagtcggacacgactgagcaacttcactttcacttgttcataaggagatagcttctgtgtgtcctggtttcttcttctgagcctgcacaggtgtcacctggacacacattgtaagcgtgtagcttgatgagttttttactaaataagcaaatctttatcatcacctcccacccagatcataacagagaatattattgtgcccagaaatttctagaccatccaaatccaatggtcctgatcactgtattacacagctgtaattggctagataggctttatgtcctcatgaggactcagtttttcttatccatgaggttcctagcttctcaagtgtaggagatgaggcctctggtccttttgtaaccctcctcgaggacttgcccacagggacagaccagccttaggccctggctctgccattggaggaagcgttggctaaaatcctgtggtcctggcacaccagaatgcttttgggtactaggtactggtcagatgctgggtagggggaggtttgttaacctgataaagcatgtgtcaggaaaatgtggagaaaagactccattgaagggtacagtttagaaagggaattgagaacatttttcctgggtttgagttctcagcctcttttagatcagagtcctcaggttgctctcctgtgtggcatgctcatcagacattcatttattcattcgcccagccaatattttctcaactcttctggccatgtcctcagacccaagggaaaactgagccatgctttggccatcaggggatggacctttgcatggcagagacagctcatcttttttatttattaagtattctaaaagtcatttatttggctgtatcagttctcagttgcatcatgcaggatcgttcattgtagcgcacgggttctctcgctgtggctggaggcttcagagcacgcaggcacagtagttgtggcgcatgggcttagttgctccactgcatgtaggatcttagttccctgaccaggggtcgaacctgcgtcctctgcatctcaaggcggattcttaaccattggactaccaggggaagtcgtcagatcattttaaaatgtcttagttatagattatgatttctgttaaaagtaaataaagcaaatggggagctgtgaggagcagggacaggaaggatttaatgggggcccagaaagttctctgaggagatgacgtctaaactgaggtctgagggtgcaaatagttccaggcaggggggtggccggtgtggaggcctcagcagaaagaacgggggaccttcacacaggaagcgggtgtgaacagaaagtggtaagcaaagggaaatggttaagtattgaaatcctgaatactcattggaaggactgatgctgaagctgaatctccaatactttggccacttgatgaaaagagccgactcattaaaaaaggccctgatgctggaggattgaaggtgggaggagaaagggatgacagaggatgagatggttgggtggatcaccgactcaatatacatgagtttaagcaagctctgggagttggtgatggacagggaagcctggcttgctgcaatccatggggtcgcaaatagtcggacacaactgagccacaactgagtcggaacaacagagtactgaaaagtgtttgctggacttctgtattatttagggctctgcagagaagcagaactcagaggagagatcagtatctataggaagacctcagacagtgtgggtcccattccagacccttagatgtaaagtgaattattgcagtaaagcaagtcacatgaatgttttggtttcctggagcatgtaaaagtaatgttcacatttctttgtagtggtaataatggtaataactgtgccaataccattatatctaaaaaaaaatcataccctaatgaaaaaatacttttttgctaaaaaatgctaaccatcatctgagcctttggtgaatcatagttgtaacaatgcaggtcacccatcacagatactataacaaacataataataatgaaaagttggcaatatttcaagaattcccaaaatgtgacacagagacacaaagtgggcaaacgctgttggaaaaatggcaccagtagcttgctgaaggcagggctgccacaaacctgccatttctgaaaaagtgctgtgctgtgctgaggagctcagtcttgtcccgttctttgtgaccctgtggactgtagcccgccaggctcctctgtccacgggattctccaggcaagcatactggagtgaattgccatgccctcctccaggggaccttcgtgacccagggatcaaacccaggtctcctgcattgcaggtggattctttaccatcttagccaccagagaagccctccccccacaaaaaaaaaaagtgcagtcgcttcaacgtgaagtaaaatgaggtctccctgctcctgtatgtagcttatgtctgtatgtgaatagaagcaaactaatttgcatattcatagttatagctactgctgctgcaaagtcgcttcagtcgtgtccgactctgtgtgaccccatagactgcagcccaccaggctcccccatccctgggattctccaggcaagaacactggagtaggttgccatttccttctccaatgcatgaaactgaaaagtgaaagtgaagccactcagtcatgtccaactcttagcaaccccatggactgcagcctaccaggctcctctgtccatgggattttcaaggcaagagtactgtagtgcgttgccattgccttctccatagttatagctagccatgcccagatgtcaactccacagagagcttccttgaatctctaggtaaagcagcacacagtccccctgccccttcccatctgtcctcacagttgtcttcaaacaactgtataagagtctaaaccattgccctttcagctcacaccactggtattcactaaaggcatatcaaagcatgaccctcagataagacctaatgtcacatatctacacgaggctctgggaactcatgcttggtgtgtgtttgatttttgtcattggcattccggatgctcttatgaagtctctggtgaaagttgggcttagaaatcatagaggtttcttttcaaagcagactgtatccccaggcaggcaggtacttgcttctgcagtggtttgaggaagcttggcctgtgagcatttttaaaaatttctaagcacatgatccaaagctaaaaacaacttatgatcttttcagtatttacctcctctgggctgatgtcctctgcatcctttgtaattttccccctgcctgtccctaattacgccagctcacctagcaatttgatgaacatcttaacgggtgttcatatcaacgggattatatttcgtaggggaatgtaattttccactgcagtcagcgatgaaagaagaggaggtcagtaaaagaaaaccttttacaagaaggatgtatttgaggagtttttcagaagaacacactataattatgaagttttatttttactgagtataatttttaaaaaaaaaacaatgtctgttttcttagatttggtagaagcatcaggaaagagaaatacttttggtattgaaaggcttgtttttcatcattattttgctgtgaggtttttttggtgcattcatcctgaacaagagagacatttgggatatttcaggctaactgagtttctgatttctctttaggttcttaatgtcctctgagagcccagcagggatataaattgagatttcttgaaataaggtatgacttttctacgtctagaatttgtgcaaaggtgatgttgctcagttgctaagtcatgtctgactcttttcgaccccatggactgtagcatgccagccttccctgtccttcacccactcccagagtttactcaaactcatgtccattcagtcggtgacgccatccaaccatctcatcctgtcgtccccttctcctcctgctctcaatctttcccagcatcatggtcttttcaaatgagtcagctcttcacatcaggtggccaaaagattggagcttcagcttcaacatcagtccttccaatgaatattcaggactgatttcctttaggatggaatggttggatctccttgcagtccaagggactctcaagagtcttctccagcaccacagttcaaaagcatcaattcttctgtgctcagctttctttatagtccaactctcacatccatacatgactactggaaaaagcatagccttgactaaacagacctttgtcggcaaagtgatgtgcctgctttttaatatactgtctaggttggtcataactttcctttcaagaagtaagcgtcttttttcatggttgcaatcaccatctgcagtgattttggagccccaaaaaataaagtcaggcattatttccactgtttccccatttatttgccatgaagtgatgggaacagatgccatgatcttagttttccgaatgttgagctttaagccagctttttcacttggcaaaggtgaaactcaataaactgttgcctgggggcgggcagcaggctgggcattccagaggattcttgcaagctgtctcagagcagccctgtccttgggaatccatacaggagctggggccactgcccccctcagcaggaagttcaaagaaaagttgtcctgaggtaattgggaataaacaggtagctcttggttagacttcttaatctgtttagctttgtgtctgtatgtgtacttgttttgtttgtttgtttgcaccaagccccatgcaagatcttagttcctcgaccagggatcgaacctgtgacccccgcagtagaagttcagagtcttaactcctagttaagtccctgggaagtccctgtagtttggttttttaatagtcagccttcaggtctccacagtggctgacccagtcactgattgtctataaagtgtggttaagtttatcaacctacagagattcaaacaacacagagattctgggtatttgccagggctgctgtatccaagtgccacagactaggcagcttaaacaataggcgcttactgtctcacagctctggaggccagaagtccaagctcaaggtgccagcagctttggtttctcccgaggacgctctccgtggcttgtagatggctgtaccttcacatggcttggccttgtgcatggtctatgtcctaatttcctcttctgataaggacaccagtcagattgggttagggcccaccccaaaggtctcattttaccataattacctctttaaaggccctatctccaaagatagttacattcagaggtactgggagttaagatttcaacatatgaatctgggaggtaagtcacagttgagccaataacgctattagtgtgtgtgtgtgtgtgtgtgtgtgtgtgtgtgtgtgtgtatgtatatttccccgatgactaagtggtaaagaatcagccggcaacgcaggagacacaagagatgagggttcgctccctgggtcaggaagatcctctggagaaggaaatggcaacctgctccagtattcttgcctggaaaattccatgggcagaggagcttggtgggctactgtccatggggtcgcaaagacttggacacgactgagcaactaagcacccccacacactgttattgtaatcttcagtctccagctgaaacagagagtaggatggtggttggaggctgtggaagaaatggggagatgttggtcaaatgtacacactttcagttatgagatgagtgagttctggggacctaacgcacagtatggtgactgtggttgatactcctgtattttttgaaatgtgctaagaaagtagaccttaagtgttctcatcaaacacatgaaaggggagacggtaactctgtgacgtgatggatgtgttaacagacttcattttcagtgatctttgtcacgtgtaacaggattgccatctgggaacgactgctcattttctttggggctcttggcttctaggttcagaatttagcaactggcgagaatcgggggagaagcagggactggcaggggagggaatttcctctttcctcctcttcctgcttgttcctcttatttttctttttccgtttgaggaaacttttcaagtaagagagaagaagggggtatcctttctcagattgacaagatcttttaaggggttataccaatgcatcttttgactttctgagatattcatttttatttcgttctgtttttaagaagtctttattccctgcctcccttgctccaccccagtcccgagctctccgagcagaggcagtcgggatgctagaaacagcaccctgatttgagtgggacgttaaaaccactggcacctttcagttctaagatgctctgacgaaatggtgaaagtgttagtcgctcagtcgtgtctgactctttgcgaccccgtggactgtagcccaccaggcttctctgtccatggaattctccaggcaagaatactggagtggattgccatttcctcctccaggggaccttccaggcccagggatcgaacttgggtcctcctgcactgcaggcagattctttaccgtctgagccaccagggcagcctgacaaaatgacatgggaggcacaaacacactggttccttagactctccagcgcgggtgcatgtctagttgctgtttcccacagagaccgagacaactctgggagagctctaggacaagacatctctagaagggtcgagaactccagactcactgctcagcgtttttttttttttcctctgtccttctagtactggcttaaaagctgtatttgaagttctagcctaacactcccctccgtcctccttccctgtcctgttcacaaatgtcccctgtgtcgctggcctttctctgctcttccatggctcacagtgatgttttagacccgtgtaaaggtgatgctagcagggtggtgggaagctcccaggtctcaggcttcagacccaaaaggccaaggcttgggggtctctgctctgtacaacctcagtcaagacatttagtctctgtgccattggattctctcatctgttgttcagttgctcagtcgtgtccgactctttgcagctccatggacttgcagcatgccaggtttccctgtccttcaccatctcccagagtttgctcaaactcatatccatcgaatcggtgatgccatccaaccatctcatcctgtcatctgcttctcctcccaccttcaatctttcccagcatcagggtcttttccaatgagtcggctcttcccatcaggtggccagagtgttggagcttcagtttcagcaccagttcttccaatgaatattcagtgaaagtgaaagtcattcagtggtgtccgactctttgcgaccccatggactatatagtctatggaattctccaggccacaatactggagtgggtcgcctttcccttctccagtaaatattcagggagtggggcaaatacattacatctcttaggatcacagtgaggctctcacaatggtgagcggccttagagaagactccagagcctagctgggtgcttgggaccatgaggagcacaggcggtcaccctcatccccaccctgcacccctcacctccctgacctcagttgttgggagctcgccccctccccccgctgcctgcctttgcaagcgctgtccctccagctgcctcgagccgcagcccataattcctgcagcccaggaggacgtgtctggatgggagcccgtcaagtgagctgcagtgatatttgaacatgagccccgatctgattattcctcagtcattcaaccccaggcaagaatggattcatactttccactgccgcctgcgccagccggtttccatatcagctggagcctcaagaagacggaaggacacgctgtcattctttccatccccgctgacccggcctgctgtcggggcgaatgccagcacgttcggccagaggaagttgcatctgctgacctgggtcgggctgaccggcccccaccgtgtccagcacacttaaagagagataagctatctctggttgttctaaagctggactctgccttacctgggaaatgatcaaggccttctccttgctccttgggaattctcagtcaggagctttcattttgagccatcgacactttgggtctgacaataatgcaatgtgacatttcaccccgtgtcctgtggtgttagttgtaaagaatgagcttgatagcaaattccatatggattcttcccaagagccctgggagatagatggatgactgttatttctatcttacagagtagaaaggcagtttaaaaggaaaaaaaaaagggaaaaaacattctcctgcttgctcggggtcatcactgcaaaccagtaggcccgagtggaattagagtttacagccctggacttgccaaaccctcaccttcctgctccgagcccagggacattcattgcggacattctatttcagttttagaaaatttcttcaagggaaatgagagatgggtctattttaggacccctgattaaatttcatttcattccattttctgaaaagcaaagagttattcatcggcaagcattaagcgacatctgagtaatgcaagaccactgttaggcctggggtcacggttgttgaattggtcatgagcatttgttaaatgtatgcattgagtcatatgttttaagagctgggagggacttggtaatcatctaatccactggcttccaaatcaggctgcttgctagaatcatctagagggcttatcaaacatagagatgccccagaactactcagggcctgggtcagtaacttgccctctgtctttagcactgaatttcttttgcttgtctatttttttcttttctttttttttttacttttttgctgcaccttgaggcatacaggatcttaattcctcaaccagggatccaccctgagccctcctggacccccagcgaagtcccagcactgcgtttctaacaaactccccaagtgcttcctaaacagccagcctgaaagtcactaaagaacccacctttgagaatcactgagtacaaatctttctttttcgcatttgcctgtttatttttctgctcatctgtttttgctgtccttcaggtaaggaatccagggcccaaaagctaagcaaccttgcttggggtcacacgactaggcaactgtcagagttgggactggaaaccctgttgtgtcatccccagggcatgagcataaacgtggcccgacagcatggcttgcccagggcaggtggccagggcactgtctgcagagccacccggacctcttctggtgacatgtgcccaggctcctgcagagtcactctggccaggacaggcctctcagaggactcagtgggttcaggagattcctccccatccctctaggagcgttgcttgtggggctgtccagaaagccttctctgtctcctggcaagcccacctccctacggctcagacgggacccaccaagaccagagcaggtgccggggcttcgcctggaaacagagctggtctgcccagttcacctgctgccctgtgatagcagcctgcctgggaaccctcctgttacacagtccgttcacctgtcatagaccatgagtatcacttgttggtggcttccattatatggcccattttattttattaaaaactttttttcttccaatttttttagaatagatagatctacatttttattttctcatggtatttaattctaccaaagcccatttccataaataattaagacctagctgtctatgatggtgagattattaaaaatcatcaatatacattatttggttgtctttcccacactttttaaaaataattaaatgcatttattttaaactgaaggataattgctttacaatattgtgttggtgtctgccaaacatcaacatcaatcagccacaggtatatacctatgtcccctcccacccacctccctcaccatcccacccctctaggttgttccagagccctggtttgagttccctctctattttgttgagatgtaattggcacacagcactgtcttaagtttcagctgtacagcatcatgatttgacttaatacatcatgacatgatcaccagaatgtttagtgaccatccatcatctcatacagatacaaaataaaagaaaaaaaaatatttttttcccccttgtgatgagaactcttaggatttactcttcatatataacacgagacagtatggattatattaatcatgttgtgcattgcattgtacttgaaatggcccacgtgtaaatgattgtccaggagacttcagatagggcgctggctatctaattgcttttttggctcagtggagaggtgataagaatacatagtgtggtctgtctcagatttctagggggtctggctaattgttactcacagcgggagacctcctaacctatgatgtaatacatttcttaatttcctcctgcaagagaattctgatgtctttctcccatccctcttccttcctggagtttctcaatctaatattctaacttatttccagatcaaatcagtgcagttcagttcagttgctcagttgtgtctgactctttgagaccccatggactgcagcacaccaggcttccctgtccatcaccaactcctgaggttgactcgaactcatgtccattgagtcggtgatgccatccaaccatctcatcctctgtcatccccttctccctccttcaatctttcccagcatcagggtcttttcagatgagtcagttcttcgcatcaggtggccaaagtattggagtttcagcttcagcatcagtccttccaatgagtattcaggactgatttcctttaggatggactggttggatctccttatagtccaagggactctcaagagtcttctccaacaccacagttcaaaagcatcaattctttggtgctcagctttctttgtagtccaactctcacgttcatatatgactactggaaaaaccatagctctgactagatggacctttgttggtaaagtaatgtctctgcttttgaatatgctgtctaggttggtcataacttttcttccaaggagcaagtgtcttaatttcatggctgcagttaccatctgcagtgattttggagccaaaaatataaagtccgtcactgtttccattgcttccccatctatttgccatgaagtgatgggaccgcatgccgtgatcttagttttctgaatgttgagtgttaagccaactttttcactctcctctttcactttcatcaagaggctctttagttcttgttcactttctgccataagggtggtgtcatctgcgtatctgaggttattgatatttctcccggcaaacttgattccagcttgtgcttcatccaacccagtgtttctcatgatataagttaaataagcagggtgacaatatacagccttgacgtactcctttccctattagggggaaatttattttccagatggtactcatttaacatggattccagtatgatgtccgtattgagcttacctaaattatatatatattgaggagggaggatcatgaggtaagtagacagagagatacagggtcaagggcaatgtaaaattgtctgtttccaccacacacatcttttttttatttttggtgtctctttattcccatccagatataaatgcattttttctgtttaattaagaggaaacatgtcagtatatgttcataacagaagagtccaaggtgtaggaaccatgtgacctgaactctatccttaccattgtgtgagcttagtgccaactctcagttagcctttgcccctgcccttctctggattttaaattctccatatgtggcatgaatggctaattaagcaactgctaagatttcctcctactctagcatttgatagttgcatctctctaatgatgcagacaacactgcaaaaagaaaaccacacacactttcaattcccattcaattgtaaaaagaaaattgcccattccagtaataagacaatgaaatcaaatccagagatatgtttacaattgtctgttggaaattgccaactcaaatgtctacaggtgacaagcttgcatataaataggtgaagccaaccatgaacaagcatttttagggaccaaggagcacatgccctgtctaaagaaggcaacttagctctggtctcctgcaggaatgcaagtcgccccgtcgaagtgcaagtcgccttgtcatccaagagaagtcagaaatccagacttttctgttcagtttcctgatatttaaatctccacagcatacatcttactcttctgcctctttgaatcctcagctccatgttggttgtcctcagcactctgaccttagctggctcagcttccttaccctacttgccactcctggtggtctgctcattggtatgtctggacctgtctggagagctgcagaccaggcttgccaccttcctaggggaccttccactccaacactcacagacatttcaagctctatgggtccgaaccttgttcacggtctttactcctgaacttaccacctctccttggttccctcccaaccactcagttgtttgagccagcaacaggaaaaatgcttctgccttttctttcatcgtcgtttattcagccaaaaggtttgtagatttcacatctcaacatgctttccatctgtttccactttcccattatacctgcaaactgtcttggttctcagaacacctcttgccttagttactgcatcagcctcctacctgggttggcgctaccaggtggcactagtggtaaagaacccacctgccaatgcaggagacataagatatgtgggtttgatccctgggtcaggaagatttcctggagaagggaatggctacccactccagcattcttgcctggagaatcccatggacagaggagcttggcagacaacagtccatgggctcacacagagttgggtatgacagagtgacttagcatgcacacacaacctcctatctagccttcctgtcctgctccagcaacctccagtctacctctggtctgtttcccaagggcttgttctaagacccattccatcatctcttttttttttttttttcatctgcttttaccaactcttctacacttattgggcttccctggtagctcaaacggtaaagaatctgcttgcaatgcgggagacctgggttcgatccctggggtcggaaggatcccctggagaaggaaaatggcagcccactccagtattcttgcctggagaatccccatggacagaggagcctggtggctacagtccatggagatagcaaagagtcagacacgactgagcaactaagcacagcacagcacattttgttgtcggtcagttgctcagtcatgtccgactctttgggaccccatggatatatatgttgtgtatatatatatattgtttttcagattcttttcccatatatgatattacagatcattgagtagcatttcctgtgctatacagtagattcttgttgattatctaatttctatatagtagttaatgttaatctcaacctcctaatttatccctcctccccccaccttccgccgcctttcccgtttggtaaccataggtttgttttctaaatctgagttgtttctcttttgtaaataagataatttgtatcattttttaagattacacataaaagtgatatcatgtgatatttgtctttgtctgtctgactgaaggtttcactcttggtgttgtacactctactgttcggttgctaagacatgtccagctgtttgcaaccccatgggactgcagcactccaggatcctctgtccttcaccatctcctggagtttgctcagattcatgtccgttgggtcagtgatgctgtctaaccatctcattctctatagcccccttctcctcctgccctcaatctttcccatcatcaggatcttttccaatgagctgactctttgcatcaggtggccaaagtattgcagattcagcttcagcatcagtccttccagtgaatattcagtgttgatttcctttatgattgcctggtttgatctccttgcagtccaagggactctcaagagtcttctccagcaccacaattcgaaagcatcacttcttcagcgtttggtgttctttacagtccaactctcagatccatacgaaactactggaaaaaccatagctttactatgtggacttttgtcggcaaagtgatgtctgtgctttttaatatgctgtctaggtttgccatagctttccttccaaagagcaaacgtcttttagtttcatggctgcagtcattctatgaatttggacaaatggataatgatgtgtatccaccatgatggtatcatatagagtagtctcactccctaaaaatcctctgtgctctgcttattcctcccaaataggctttctcctcccaagtaacctctgatcttcttaacaaagaaactgcctagcattgccagtgcctagcacagtttcctgccatgttgtgtattattaacaagtatttgacaaatgaatgagtgttaacaagtcacttaaaaactgagtcatagaagtgacccaaaagggaaagcatggttcattaagtatctctgcattgtcttctcccacgatgctcttgagtatgatcaaaaatcatccaactgcagtagatttcctgcctagcagcaattagacttcatggaaatctgcccagtttaaattttaaaacattcatgtgcatttaccaaaacgtgcagatttctttagtgtttctgcattattctcaagctgccctaatgtctttcttctaaagatgatacttgctggctggtttgggttttgtttgtaataaaatgtattattcttcctttaaaaggaaggctcagtttaagagcacaaaaggcagtcagagacagagttaaagtaagaagactgaacccctaacagccgcccacccgccgccactctctgatttggaactggatggtggcccaggggctctttttctccttgtcacgggctcgtctggaaggtggccaggcccctgcccttggagaggccctgttgctggaaagaacgggtcagggagagggcacggttgaggctaggggtgcacatgtgagcctgcggagcttgtggtcttgggcatcatccttcttggacaaaagtggtgcagaaggaggaacactgagcaacagaaggaagaacctggggccatgtactcgaaatcatgttttttatctttgggtgattcctagggatgtctgggcttcccttgtggctcagctggtaaagaatcctccttcaacgcaggacacctgggttcgatccctgggctgggaagatcccctggagaagggaaaggctacccactccagtattctggcctggagaattccatgtactgtatagtccatggagtcgcaaagagctggacatgactgagcgactttcactttccctgtggatgtctacgctgctgagttcatggacatgaatcaaagtcttcctcaagctctcctacacattctgttttttctcctctagtcatcccatctgggatggaggattgtggaaatgtctggagggccttggctcactcactcacccaaaataaccaagacttaaccatcgccaagagcgccgtggagaaaaccccagctcaggtgctatacaagccttgtagggccaattcaagtcctctgagcttgtttcttcaccagtaaagcagacctcagagaactgtcccaaggatgagtgagctggctcatttgagggtcacatagtggctgctgtctcatctacccttctgggtctcagttggtgattttggggggcatgtcctgggttcatggagttatgctttgttgtttttcagtcactcagctgtgtctgactgtttgcaaccccatggactgcagcacgccaggcttccctgtccttcattatctcctggagattgctcaaactcctgtccatcaagtcggtgatgcacccaaccatctcatcctctgtttcccccttctcctgccctcagtctttcccatcatcagggtcttttccaatgagttgactctttgcatcagatggccaaagtattggagcttcagcttcagcgtcagtccttccaatgaatattcaggactgatttcctttaggattgactggtttgatctccttgcagtccaagggactctcaagagtcttctccagcaccacattctgaaagcatcaattcttttgtgtttagccttctttatggtccaactctcatatccatacatgactactggaaagaccatagctcatatgtttatctgtgtgtgtgtgtgtgtgtgtttgtcttagcacacaccaagtccatccatgttgttgcagatggcaaattttcattctgtttatggatgatatctttatatgtttttatgacataggtaattttggcaattttctattagttggagaattataatatacaatgtctgtcataacaggaacaaagaaaattacaagcagcagcagttataagatgtactcgggcctcagaggagacaggaggggacaaaattgagggaatgaatgaaggctttctgtttgggaagaaggaaggatgcttcttattgacatgatagcaaaggagccaagtcaagacacagaaaaatgttaccgtacagaggggagaagttgatccaagtgtcttgggcttgataagcatataaagtggaagtggagggtatctacttagacggaacactcaggagtacaaaaagggatgagacaccagcggaggcaacatccagtgaagtttgacctagaggccttgaagatccagctgaggtacacaggatgtatttgtggtgggaccggttggccaggttttgtaacatccagggctgtgagcaggagggagactgatgtttggtggcaagcatggtaacaggactttgatgagagaacttgatcgaggcaaaatattttcatcagtgctgttaatcaagagatgagctcagtaatcctgactttatccgagtcccagtgttctctgtgtccctcccccaatccccatccccatcaccatgccagagttcgtcccaggaagaacagagacccagaggaagctgggaactttcagtccccaaatctgagggtctctgctaccatctttccatttatatcaagttcaaacattatccttggatccccatcataagaccagccatttctgtttgcccacagaattttcagcttggatataggggtggagtccagataagccaaatgcacccactttcatggactttatttattttaaaaaaactttttttttttaaattatgtttttggccgtgctgggtcttcgtttgacgcgtggacttttctctgttgcagcaagtgggagctactctccagttgccatgcacaagcttctcattgcagtggcttctcttgttagggagcacaggctctgggtgttggggcgtcagcagttgcggcccctgggttctagagcacaggctcagtattgtggtgcacagacttagttgctcccagcatgtgggatcctcccagatcagagagtgaaaacacctttgtcctgcattggcaggcagattctttaccactgagccaccaagaaagccctttcatggcctttagaatgttgaagcagggaaaaaccttagagatcaagtgtgttagtcactctgtcatgtctgactccttgggaccctggggactgtagcccaccagactcctctgtccgtggaattttccaggcaagaatactgtatcgggttgccatttcctcctccaagaagaaaaatgactctttgcgactccatggactatacagtccagggagttctccgggccagaatactggagtgggtagctttgtcccttctccagcagatcttcccaacctaggaattgaactgggatcacctcattgcaggcggattctttaccaactgagctatcagggaagcccaagaatactggtgtgggtagtctatcccttctccagaggatcttccccacccaggaatcaaaccagggtctcctgccttgcaggcagattcaagagatcaagctcagtggttttatacttgtctcatttttgcgggggtggtgtttttaatgaaatgttttcttaagatggactcttccactgaacacagagcgaagtgcagctgcccccttcatggggcactgtggccacagacccgctggatttccccttatattataattgatgaaagggcaggcaaggtcagagcttgcccgcgggccccctgtgttctcttctctgggctgtcttcctgccaccgagaagcagcaggttctggacctgaaagggccgtggacagatccagatctttgacattctagcctcacagggatgaaaggagatagatatctcaggagacttttaatccgaggttcttttactgcagcctcttatgaaatcccttggttagaggggtgttaactgctcgtgttctggccccacagatgcctatatgcccttcagataaagggcaagctcaccctgaagattttccagcctctcatccacagcaacatggggtgccatattccccttatgataacgagagctcttcttgcaatagggtgatggttctctgcctttccttggtcaccaattgtgttaatgatcattaaattaggtctttgataggcctgccagtaaaagcagtttgttgtaatttaccaaattaaataaagtgtcttgctgattaaccataaagtcatttaaaaattgtatcagccgggacttccctggtggtccggtgggtcagactccggctcagactccacacccccaacgtggaggacccagtttccatctgtggtcagggaactagaccccacatccctcaactaaagatcctgtgtgccacagctaagacctggtgcagtcaaataaataaattaaaataataaatgttaaaaattttatctgtattctctgttgctctcattgttcagtcactcagtcatgtccgactctttgcaaccccatggactgtagcacaccagccttccctgtccttcactatctcccagagtctgctcaaactcatgtccattgagttggtgatgctctgtgtagttttaacttaaaatgaattggttggcaacatttgatttcataaattaaaagtgcatttgagtttgacataatacttattgttaagtagatgtatgcttaatttttatagaatacattaatcactttttaagtggtgatttatttttattttttgaggagaattttgtcagaaaatcaaactatgttttagcatagttttaatgaaatgtttaaacacatttcagtcatttataaagcaacttccctctgagaacacttcaaaatcatggttaatttttgtgggtctctgtcaaagtttgcaacttgcttgagtctgtgatggggaaaaggatttttgaaaatatacatagttttatataaacccatgtaaatctctataaacaggcattttctagtgctttgctaaaagtaatttgtaggtcttcttttcaaattgtgtttggagcaagttcactgagtacatgagaaaattagagaggattgtgatcacattctaagggtgtccctggttgctcagacagtaaaggatctgcctgcaatgcaggagatctgggtttgatctctgggtaggaaagatcccctggagaaggaaatggccacccactcctatattcttgcctggagaatcccatgggccgagaagcctggagggctacagtccatggggttgcaaagggttggacaggactgagcgagtaacatacacacccgcaatcacattctattttggagttataatagtgttattaggttgataatgtacttcaccataccaaatttcggtttcaagtgttcaaaaacagaaagaaaagaaaccaaatccactacccttaaagggtagagatgtgtcatcagaaagatgtgttacagatgatgcagaaaatgtgttatggatgatacaagcaatatggaaagtgatttccaaaagagttttgagccataaagcacgaagtacgtggacaatgtgctttacatatttcagtagcagagtgttgattcaagatccaagccagccaggctgctctgcagtctaaacttattgtttgagaagttgtcatttgcatccttctcatcctgttcttagaatatttttgtctattttcacaagggctcttacaccactggtacttaaattaatggaaattatgtgtggaatggaatgtagttaatggaagaagcaaatcacctagtcttttggagaattcttgagcccaagaagagctggctggatttccctccctccctcccccaacttcctctctcccgaacctcttactttctttccttcttcctttctttgttctttgtttattccttctttttccttctttaaattattatttctttacttgatttattgtcatttatcttctccagagcataatttacctataccacctttttctttttttttaactcttcatgtttagaaaggaagaggtctttttcatggtctgggatcctctagcttgatgggttttctttaaaatctcctcagtcacctgagatgaagagctgactccttggaaaagaccctgggaaagatggagggcaaaaggagaaggggacgacagaggatgagatggttggatggcatcaccgactccatcgacctgagtttgagaaaactccaggagacagtggaggacaggggagcctggcctgctgcggtccatggggtcgcaaagagtcagacacgactcagcgacggaacagcaacaacaggcagcacacttcctgaaattccactcagatgggggcacgtggttctcctggtggggcctggaggacacaggccctccctgccctgtgtcctctcccccaggctcggtctgtggttggaccgtgccgtgcgctcccggagaagcagtggggacctgcctcccatctcctccacgccctcaaactcccttagagaacgtgccctgagcccagtgacctttggctccagaaaggaactaactgatgaacccagacaaggctgtcacctctctgagattgtttcttcccatgtaaatggaattaacatgtacccagataagaagttttaaaagataatatgtacgagcactgacacaccgttgccagcacataggatgtgcttacattgttggttgctttcccttccttttctttccttttccctccagctaacccctccactcccgtgccttcgtgttccatcccggaggctcggccttgagacgcccctgctccaagcagtgcccagagggcacacagcaggaggcgctctggggtggggagcaagggggggtccctgccttctgtctgcagcccaggaagttctttccccccagatcatggtcagattgggtttctaatccaagatatattagcgtgcacagagtcaccacaaaataaaggcaacagtcatttttttttaccgactcaatggatgtgagtttgagtaaactctgggagatggtgaaggacagggaagtctggtgtactgctgtccatggggtcgcaaacagacatgacttagtgactgaacaactacaacatttaaaacgatgacttcagggaaatgggctctcttttttgactgggctctcagtctttcaggattaagggaaattcttacacagcaattctcccagcttcaaaaatcagttttattccagaagattataagtcccatttgggatttggaaggtattttcccatgtgcccctgaaaaggcaggtgcaaacatgttctattctgtgggttccattccagctgtccatgagcatagtaacttagagaaggaaagctcccttctgcctagaccccctcatccttaacaggccatcagtatgggattcctcccattaaggtgaaaagtgaaagtcgctcagtcgtgtccgactcttaatgactccatggactacgcagcccatggaattccccaggccagaatactggagtgggtagccagccgttcccttctccaggggatcttcccaatccacagagcgaacccagatctcccacattgcaggcggattctttaccagctgagccaccagggaagcctaagaatactggagtgggtagcctatcccttctccaaaggatcttcccaacccacgaatcgaatcagggtctcctgcattgcaggcgtattctttaccaactgagcgatcagggaagcccacctcccaccccccaccccattaaggtaaggagatccatctaaggagctccgtgtaccgtaaacatcaaggaactaagatggcaccaacacacctttgctccctggcactcctgccattttccaccatcagatgcacattttagactcaattgcaacttcacatcattgtaaagatggaaaacagaattctcaaaattaaccttaaggctaaaacacactctactcaaggtcaaccttttaacagccaatcggattatgttggcaaggtctctccatggatttggtgtcggggaggaagtgcatccagtctagagtgcctttctcctgcctaacagaagcacagaaaagtgtctaggtttcaggacagaattcggactttgggggtgggggtagggggacgatgaggcattagataaggcgtcagcagccagcggatgtgctgaagcaggagtcagctttcagtgtgcatctcagacttccaacaataggacctcggtgtgcttgcaaagctggggctctggtcctgagtggaaagctcacgtccgcgtggacgctgcataagagcacggccacacaaatcggcaacccctctcctgttttcagagccaagccccttttatccatcatgagaaatttggtcctgaccgtgagaccaaccgaatgcacgcgagacaggccagtatctagttcactctgattatcttctgcccagtagcagacggaagtctggaatatagacaaaagagagagctgctttccctcccctcccccttttcctgttacgttactattccattacaccagcaagagcagcaagaagtaggaaattccagtggagcccatacttgctagacatgtctctggttgttaagtttatatcctgcaatgatttccctaagcattttctctgtcagtaactgggctgaagttttccatttcaaagttgatttaaaattagtccgaatggctggttacctttatcgaagagagggatacctcctagagcttgtgttctccatctttcaagtattcagggtttccttttgctttaaagcccttggtttgtgcccacacagcctcaaattgcagaaacaggcagaaccataacggggcttgggggttgcacaggagtgggaagatggcaaagctataccgtttatcagatttttagtttaaagccttcaagtcaaagaacactgatgtgagggtgcctggtgtgactctgacctctcctcagctccccttccaggtgaggacgaggctcaatggtcctggatatctcctcggggcctgatgcactcttacctcttggcccagatctgtgtgcgtgccctcatgcacatgagtgcctggcatgtgcacatgtgcaaggtgtctgtgtgtgccttgtgcacatgtgtgcacacactgggaagggaaaaaggaaaaggaacagggaagcagaggcagggagggtttggttccttgtaactgagaagctagaggacaaaggaaccgtgttggtttgggagtggggtgcggaggcaacctggcactgcttgtctcgtaatcaggacctccgcagaccccggcagtgggcactggccctgggcccagggctttcccacagtagctctccttcatccacatccacacgccccgcaaggggacatgtcacccagaccctccacccctccattaatgccacattctgggtactcggttcagttcagtcgctcagtcgtgtccaactctttgaaaccccatggactgcagcatgccaggcttccctgtccatcaccagctcccagagtttactcaaactaatgtccactgagtcggtgatgccatctaaccatctcatcctctcttgttcccttctcctcccaccttcaatctttcccagcatcagggtcttttccaatgagtcagctgtttgcatcagatggccaaagtattggagtttcagcttcagcatcagtccttccagtgaatattcaggactgatctcctttaggatggactggttggatctccttgcagtccaagggactctcaagagtcttctccaacaccacagttcaaaagggaagtcaggaccctgcagttccctccccaagtgacccaaatccacttccaagctctgtgtgagcctctttccccagactgtggactgagccacaggtgatgccctgctgggccggaggggggctgggagacccagtctccagggctgtggacagagcttcaccacgtcatcttcaattcccaactggcatggggaagtccccttgaggtgtcaccccagggtgtggggagcaggcaacggtaggagaggtcaatattctgtcagactccagtgagggacaccaaggagtctgagatcttaaatttgagccaagtactcctgaactctgtgactctctctgtcgactcaagttgcaataacacaaccccataggctgggtatcttataaacatcagagaggtatttctcacagccccagaggatagaagtatgagatcagagtgccagaaaggttaggttctggtgagggccctcttgtgggttgctggctgttatccttacgtggtagaaagactgagtgacctcttacctcttctcatgaatgcactaaccctatgatgagggttccaccctcttgacctaatcacttccttaaggccccacctccaaataccatcacactgggattagggcttccacatctgaatttcaggaagaacattctgtgcattgcaattttttttttcaaggcagtgatagcttatggtgaatgatgtcggattcctgatctccaaagaagatttagcttcagggtgatagcttatggtgaatgatgtcgaattcctgatctccaaagaagatttagcttcagggtgatagcttatggtgaatgatgtcgaattcctgatctccaaagaagatttagcttcaggaccagggaccaggtttgatccctcaagagtgtttgtgtagcagagttttattaaagtataaaaagggacagagcaagcttctgacacagacatcagaagggggatggagactgccccctcactagtcttagcaagggagctatatgcagttggttattaagtgaaagtgaagttgctgagtcgtgtctgactctttgtgaccccatggactgtagcccatcaggctcctctgtccatgggattttccagacaacagtactggagtgcgctgttgtttcctcctccagggttgggtccttctcagttggttattacagtaaatcagaagaatgtctcaaggttgtaaatgaaaccttagctcattgaaactaagccatgccatgtagggccacccaagacagatgggtcatggtggagaggtctgacagaatgtggtccactggagaagggaatggcaaaccacttcagtatgcttgccttgagaaccccatgaacagtatgaaaaggcaaaatgataggatactgaaagaggagctccccaggttggtaagtgcccaatatgctactggagatcagtggagaaataactccagaaagaatgaagggatggagccaaagcaaaaacaatacccagttgtggatgtgactggtgatagaagcaaggtccgatgctgtaaagagcaatattgcataggaacctggaatgtcaggtccatggatcaaggcaaattggaagtggtcaaacaggagatggcaagagtgaatgtcgatattctaggaatcagcgaactaaaatggactggaatgggtgaatttaactcagatgaacattatatctactactgtgggcaggaatcccttagaagaaatggagtagccatcatggtcaacaaaagagtccgaaatgcagtacttggatgcaatctcaaaacaacagaatgatctctgttcatttccaaggcaaaccattcagtatcacagtaatccacgtttatgccccaacgagtaacgctgaagaagctgaagtcaaacggttctatgaagacctacaagaccttttagaactaacacccccaaaagacgtctttttcactataggggacaggaatgcaaaagtaggaagtcaagaaacacctggagtaacaggcaaatttggccttggagtacagaattagcagggcaaaggctaatagagttttgccaagaaaatgcactggtcatagcaaacaccctcttccaacaacacaagagaagactctacacatggacatcaccagatggtcaacacagaaatcagattgattatattctttgcagccaaagatggagaagctgtatacagtcagcaaaaacaagaccaggagctgactgtggctcagatcatgaactccttattgccaaattcagacttaaattgaagaaagtagggaaaaccactagaccattcaggtatgacctaaatcaaatcccttatgattatacagtggaagtgaggaatagatttaagggactagatctgattgagtgcctgatgaactatagacaggggttcgtgacagtgtataggagacagggatcaagaccatccccatggaaaagaaatgcaaaaaagcaaaatggcggtctggggaagccttacagatagctgagaaaagagaagtgaaaagcaaaggagaaaaggaaagatataagcctgtgaatgcagagttccaaagaatagcaagaagagataagaaagccttcctcagtgatcagtgcaaagaaatagaggaaaacaatagaatgggaaagactagagatctcttcaagaaaattagagataccaagggaacatttcatgcaaagatgggcttgataaaggacagaaatggtatggacctaacagaagcagaagatattaagaagaggtggcaagaatacacagaagaccgtacaaaaaagatcttcatgacccagataatcacgatggtgtgatcactgacctagagccagacatcctggaatgtgaagtcaagtgggccttagaaagcatcactacgaacaaagctagtggaggtgatggaattccagttgagctattccaaatcctgaaagatgatgctgtgaaagtgctgcactcaatatgccagcaaatttggaaaactcagcagtggccacaggactggaaaaggacagttttcattccaatcccaaagaaaaacaatgccaaagaatgctcaaactaccacacaattgcacttatctcacacactagtaaagtattgctcaaaattctccaagccaggcttcagcaatacgtgaactgtgaacttccagatattcaagctggttttagaaaaggcagaggaaccagagatcaaattgccaacatctgctggatcatggaaaaagcaagaaagttccagaaaaacatctatttctgctttattgactatgtcaaagcctttgactgtgtggatcacaataaactgtggaaaattctgaaagagataggaatatcagaccacctgacctgcctcttgagaaacctatatagaggttaggaagcaacagttagaactggacatggaacaacagactggttccaaataggaaaaggagtacgtcaaggctgtatattgccaccctgcttatttaacttctatgcagaggacatcatgagaaacgctgggctgaaagaagcacaagctggaatcaagattgccgggagaaatatcagtaacctcagatatgcagatgacaccacccttatggcagaaagtgaagaggaactcaaaagcctcttgatgaaagtgaaagaggagagtgaaaaagttggcttaaagctcaacattcggaaaactaagatcatggcatctgttcccatcacttcttggcaaatagatggggaaacagtctaaacagtgagagactttattttggggggctccaaaatcactgcagatggtgattgcagccatgaaattaaaaggcgcttactccttggaaggaaagctatgaccaacctagatagcatattaaaaagcagagatattactttgccaacaaaggtccgtctagccaaggctatggtttttccactggtcatgtatggatgtgagagttagactgtgaagaaagctgaatgcagaagaattgatgcttttgaactgtggtgttggagaagactcttgagagtcccttggactgcaaggagattcaaccaatccattctaaaggagaccagtgctgggtgctcattggaaggactgatgctgaggctgaaactccagtattttggccacctcatacgaagtgttgactcatctgaaaagaccctgatgctgggagggattagggacaggaggagaaggggacgacagaggatgagatggctggatggcatcatcaactcgatggacatgagtttaagtgaactccacgagttggtgatggacagggaggcttgatgtgctgcaattcataggtttgcaaagagtctgacatgtctgagcgactgaactgaactgaactaccagacccactcccacaacatacattttaagatcataggattagaactagcaatagcaagatcttaccggacccactcccacaaaatacactttaagatggcaggattagtctgaagattcttaaggttcatgtcctggagcaagatacagtgttgttacataatcattggttcagagtttaaggaaaatcatatcctggagtaagatgagttgttttgttgtgtaatcattagctctgcttaaagaaaatgatgttgcatatgactgagatgtgggaatgtaggaaaaaaaagtttgtcactttctcctctttgagagccccagacccctttctcctcctcctcaggggcactggatttctcatcaacctacctaagaattaactctctcagtgagaagatggaaagtatttaaaatttattattgatgtataatttctggccgtgtagatacatggtatgtgggccagcatttattcatggaggcagcctgcttcaaacccctgcactgttaatcttgggctgctctggaattcacacaggatttggaggctagggtctgcgaaggactttccgtgtccaggagccatctgtgcgtgccaccttgctgtgcccaggcccacccatgtctatgccacatggctgcccggcctctgcacctgggaaagggcagcttcctctgtccccaggcttctcgtttcatctttacacagctctgaaagtttccccatctttgaagccagctctccccatttacactgtggaattatctagaacattccagaaaggtggaaggttaggcaagaaacggaaagctccccaatgaatgcagtaatcagccttcgctgcccaggagacaggttgcagctcccctgagacaataagctcggaaagccttaaaaataaattgctaggagaatgaagtggaacaggaagacatacaaaacataagctttaacgttttgttgttagatgcagcatgcaatttttctgataaattgctttaaaagtttgtgaacgctctcagtttctgttgtgacctcattgcagacgtgcgctgtccacagaccacacatgccagtcaacatgaggtcatgtcactcactctgtggtcctgatcagtgccatgcatgcatgtacaacagtgagcaaaaatctagacacaagcccgcccttacggagcatcagtcgcatgcgagtacacaggcattgtggagggagacacagtgaagcccttggagtaaaaagtcctgtcatctctctgcggctaagatttattaaacataagtggcaaaactttcagagagcacgtagaggaaagaccatcggattcatctagcggtgccctttcttcaaatggcaaaagttaaggtgtcagccaggaagaggtcctagtgctatgtgatggggtcctttctagtgcaggcagtgttttcttttttttaaattaatttatttggctgcatcaggtcctagccgcagttggtaggctttgttgccctgagacatgtggaatcttaaggactagggaagtcttaggcagtgttttctgatctgttgtaatatgtgacacacacacacactcatgtaagtgatcactatcagagtgtctttccccaactatgactgtctaactggataatatggctgtttctcagctgctaagccccagcatcccagtcaccatgtaaatggcacatccgtacagatttggggcgggggctaggccgagaggcactgctagccgcctctgggagaccccagctgtgcagtgtttttcaatcagcgtttctcaaactgtctctgaggatgacctgctttgtttcaaccttttgccaactaataaatagaatataataaaaatgaattactagaattatgcatgggaagatagacaaaacacaagccgtaatgttttattggtagatgcaacagatgggcaatttttctgataagttgctttaaaagtttctaaacactctcagtttctattctgacctcatggcagatgggtgctgaccacacttgggttgcactatcctaaatggcaagcaggggtcaaagcttggactcaaaattgtaaacgtgtatttatcattacgaggttttcataagcttctcagaaaaaagaaaatcaatgagtatcatattcaatttgcattactctataaatttcattaaaaatcttttccgatgaaaaaaggcagcgttttacatagttgtgatccttaactgggtttttgttctgcttttattcactggccattttctcacgtgtgtgtgcccggcactgctgcttgggtcctggccctcctcgcctcccacctggtggctgtcctaacctccacgcggctctcccctctgacccctgttccccgttcaggtcaagctctgcgaggtgcctggagtggtcttcccaagtctcaggcctcatcttgttccttctagtggcctcccagttcttttaggatggtgtctacatccctccaaggcctgatctggccccctcttgcctctccagcttcatttccttagacatttctctatcatgaacagctctgacctaaacatcttcataccatttgtcttttttttttaaatacactaattgtgcatagttgtgtctgatgctttgagagcccatgggctgtagcccaccaggctcctctgtccatgggattctctaggcaagaataccggagtgggttgccattctcttctccaggggatcttcccaacccagggactgaacttgggtctccctcattaaaggcgaattcttaaccatctgagccaccagggaagcccaatatactaattatttctcccaaatgaaaccatagagtccaagatcatggaccttataaacacagttggtttcatattgccaacttgttttccagaaaggctgagccccttttcagcgaaaacaccatgcatcctgaatttcaactcaaaaaggtggggccaatattggcaccaaattaagtttcacaccagagcgtatagtgtgttcttaggtttctagtgaagtgtgaagtgttagtcgctcagttgtgtccgactgttggtgtgtgtgtttgtcactcagtcgtgtctgactctctgtgaccccatggactacagtctgccaggcttctctgtccatggaattctccaggcaagaacactggagtgggttgtcactcccttctccagggattagcctgggtctcctgcgttgcaggcagattctttaccatttgagccacagagaagtcttaggtttctagtagctcatgtcaaatgaagtgcctttctgctttggctgttagttctgaaaaggcaggagcctgttctccagctttcttttcccctgaaaacagtggacacccagtcaatacatgatggcagtggtgatgaccgagtctgaggctgaagtgagtagaagttaagataaagggtttgttgaagaaaaatgcccttccctatgtgtccagcagaggtgaagctggaaagtaacaaaggtagccgggcatgctggtgccagaaggttgacaaggatgtgccatcaacagcatctttgattgtttgggttaagaatatcagattaatgtgtatgctcatgataatagttccagcactgtgagcactttacacatctcctattgaatccccacaacaactgtgtgaactagcatacctttttatcaatgagaaactcaagcccatagaggtgaacccgcttgcctgaggtggcaggtgcacagtcccaagagtgaagctggggttcaatcctgggtggccccaacactaccctgagacaatgctgtgttgaacttctccatatgtctgccttgtcattcttttttgtgtttattattgttgttgctgttattcttataggaaagtcacaaattcaatacaggcagcttttttttctgagccatttgaaaatagttgccaaccacgtccaccatccctgcctacagtagaatatcccctaaaacaaggacatgctgccgaattatcacaatcaaactgtagggatcaggacataaacactgatatattgctgccgtgtaatcctgagactctgttcagagttctgcactggtcccccgtggcagcctttggatcctggtggagctcacatgtgcccagttggttgtctgaagtcttgagtccacttcggtttagaacggctctcccatctttcctggactctcaggacctggacacttttgatttgtcatttcattgaattgccatcagtgtcatgtttcctcatgattagatttcaggtctcatatctctgttttgggttttcttttaagtacagctcagcagtgttcaatatactgacgtcgctgtgcagagacactgctgtcctagacatttcgggtgtaagaaccctgcaggagggtgcgggctgtgctggcaccgccgtccccccggcctgctctcccaaagatgcactccctctgagctccgtgggcctccccagggcctaccctgggcctttcttcctgtgccacccggttgtctagcctcccctagaaagtatgctttcctaggaatgcctggcccatagtaagcattcgttcagtgatggccaaatattcagaatgctcgggggtaattatggcgtatagagccattggattgttcagaagcacgagcgtgttcccagactgctgtcgctgcggacgtgatcagggctccaggaagtctttattgatttacagctaacatgtgaccttcagaggttaccccagtgggaaacagagcaagacggttgttttatgtgacttcataatggaattcacagagcgctcaagattttcctgaagcgctggttctgcctgacatcacagaaaatatgaggccgatctgggagtggcccgctttggttaatgcagtcacatttaagaggatgtaatggagcgtaacactagtgtactggaatgacacacggtgtggaattttctgggtagatccttgaattgaagaagataggatcttgagcctgtgaaggaaccaaaccctgagcctgtggaaaattcagtgggccaggagccagtccggtgtgccccagctagtttgaacagtaagaccattgtacccctccccacccaccaccaacgtggggccaatgttgacagaatagttccgagttaaaattcagcttttattggtgtcgacactgtatgaattcctgtttagcttcttttcataaatagatgactcaagtaactaacttttatgtaacctaatccaggaagaggtaaacattttccagagagagctcattcttgaagttctgctgtcaaatattcaaactagccacgaagcactagcaacagtattttattatactcctagaggaaaggaaaactagtccaatgcatttttgtttacatacagagcatcagaatggtactcaaataggatacacaggcagatcactgttttctttctttcttctttttgtaacttttttagttttttttttttttttttttcttactgagtggcatgtgggatcttagttccctgatgagggatcaaatccatgccccctgcattggaaatataaagccttaaccggagtgccagggtagtccctagatcattattgttgacatcaaaaatagtccagccatgacttacaaatacactttagggatttttttttttggtactaaaaataaaagttttaaagtaaccaagaagagtttcttggtgctggagaaaatggcatacgttttataccatatttacaccgatcatgatttcagcacagcattcatttataagtatcctcagagaggctttgctggatattactctttttcgtttcgtcatttcaccattcttattctccatgtaacttcacccaggctctccctgtgctccctaaacagatgtatccttctgatgtctttgggaaatgatgtcagtttttctgatttttcggacatcttgtttttgttgtcacttcaaccagattttcttctggtacatttcaaattattacattaagtattaaaattattaaggaattgcaaaatagtttccattataaaaccttgttttcattatttaaaactattcgacaaccttccttatggaaagatggtttttagtaagtgtatgtcctgtgaaaatcaacagccttgagatgaatatcaatatggaccttgtctgcctgcagctgttcttgctcatcagtttttattcttattcactattacgtgtctcttctaagtacgaaagatggagaaatggtaaggactttttgaattcctacataattctaggttgtaatccttatatcaagtagttcacagaggttttttaaatttttatttaaatttttatttttataaaggaatatatatatattcctttttagattcttttccattgtaggttattacaagatgttgagtatcatttcctatactctacagtagttggttatctattttctgtgtagtagtatgtgtattttaatcacaaactcctcatttatcctctttcataattgtaaatttgttttctatgtctctgagtctatttctgttttgtaaataagttcatttatataattttttttagattccatatataagtgatatcatgtatttgtctttctctctgacttaattcacttagtatggtcatctctaggtccatccatgtgctacaaatggcattatttcattcttttttgtggccaaagaacattcctttgtgcatgtataccacatccttatccatacatctaccagtggacgcttaggttgctcatgtgtcttggctattgtaattagtgctgctacgaacgttggggtcacgtgtatcttttcgaattagagttttctcgggctttatgcccagaagtgggatcactggatcacatggtatctctattttcagttttgaaggaacctccactgttcttcacagtggctgcaccaaattacattcccaccaacagtgtcgggagggttcccttttctgcacaccctctccagcatgtattgtttgtagcctttctgatgatgctgtgagatctcactgtctggtgtgaggtgataccatgttgtagttttgatttgcattgctccatagaggagttgttttgtttttaattaatttatttattttaattggaggctaataactttacaatattgtggtggtttttgccatacattgacatgaatcagagacacacatgtccacagaggagttttaaaaccagccttcatcacagaaacttccagccccttccagtgtgggtgcttcctcactagccccttcatgggcagcttgcatctgtgctgacatgtgcctttgatgagccaacaccttcagactaaagcatgcttgtcaggatcacaaatcacgcacctctgttaacagtttaggctgatttggggtttgtgctagagtgctcagaatgcctagaacctgacatcttggattctaaaataaatttaaggaaaatgttttaatggtcttaactcttacctcagttcagaacctgacatgaatgagctcaccaaccaacgtcacctttaagacatgtttactgactcaccacagaaatctgaggacatgtgtatatacctcaactaggccttttttggtactgtcttaaggatttacaagaacgtgtctttggttacagccatcctgggtaataacagtcagagggcatgaacgtgcatgttacatgttgccagtaggagcttcatgaccttaggcaaccgatctgagctcactgagcctcgtttctgcaaaagcaagaataataaaaccctcctctgtatcactggaggatttcaggcaactcagatgagttggtacctgtggcgagacttgtgaaacaccaagcgtgggttgaatgtaacttaaaattgttattattcagagccggcataataaaccggaagtggggaactgtgttctcagaaggtggtcaggcccttctatgggacccggttctggatgtttcaactggcttaatccgtggaacaagggaatatttgacagagtggcatctgaagcattaagctaactagaccattaccagcaggacctttgtgcaccttacaaacaagttctttatcttctccctgcctacggaagttatagaaccgcgtacataataggattcagtgtggagcttattagcttgaacttgtctgaacttatgttcacaagcctacccacccctatctagatcaaacagggtcagataaagagttcttacgaaagaatcctgtgctgtgaatcaaacacagatcacgttaaacttcctgacactacttaatttttcaggcaagttttctttcttcttcccccacccccttatcctgaccttggatgaattttccaatggttcctggaataagaaggctacattcatccatctttgcatcctcacaatttccagtgactctcaatagaaatttcatgcagctaggctgacagtaacttatgttctttttttaaaaaaccaatgatgagtactcggaagcctatttttagtattcaggtgaaatggttttacagtgctccattagcatagctattaatacacttgagtgttaatgtctctgcttcacttccccacagtttgtcctgttctataagctgaattatgttccaggtgatggatgatctttcctgtccctgctatcatccccctggagctcctttaccattgattttgcaacaggtgggccagatccaaggaggtgaaatgtgctccccagcatggcctagcttgtttttgccaaagctggagccagagactgaaagtgactcctggaccagtgtcctaagatgccatcagttcagttcagtgtccaactctttgcaaccccatggactgcagcacaccaggcctccctgtccatcaccaactcctggagcttactcaaactcatgtccgtacagtcagtgatgccatacaaccatctcatcctctgtcatccccttctcctcctgccttcagtctttcccagcatcagggtcttttcaaatgagtcagttctttgcattaggtggccagagtattggagtttcagcttcaacatcagtccttccaatgaatattcagggccgttttcctttaggatggactggtttgatctccttgttgtccaagggactctcaagagtcttcacagctccctggaaaaccagaataagacctcggctcttcaaaatccttacaacagccaggttttctgtaggaaaaggatataacattctgattgttagaagtttgatgtttaactatttggagatcctaaaggaaagcaaccctgaaggattgatggcatcagtggctatgagtttgagcaaactccaggtgaagtttgcttcaatgtttgcttcaagttcacctattcatggtgaaggataggaagcctggctcggcgcagtctatggtgttgcaaagagttgggtacgactgagtgactaagcgacagccatttgaagattagtgtctaatgtttcacagtccgtcctgccttaatcttaaatagagatgaaaggatttttttgtttgtttgtttttgagaatttcctttcttggtaattcttctttttaaaaaaaaaatatatttgttttttggctgagctggtctttgttgctaccgtgcaggctttcttgagttgcgcagagtggaggctgctccctggctgcagcatgcaggctttcatcgtggcttctcttgctatggagcttgagctctaggctgtgcaggctatagcagcttcggtccctaggctctacagtgcaggcttagtctgtggcacgtgggcttaattgctccgcggcatgtgggatcttcccagaccagggatggaactcatgtctcctgtatttgtaggtgaattatttgccactgagccaccagggaagccccttttctcaacaattcttgataatgcctttcctagctgactccagctcatcaatcagtctgagatttatttactgtgtgttgccgtaggtggaggtgataagatataaaattttatataagatatataaattttatcttttataagataaaaaatagcaagcccgaggcctgctttcttatagaaggtcactggccttgcaaactttttgatgattttttttttttttgaccatgttcctttgttattctgtcagggcagggagccagcatgggataacatctgccctggagtggccaggtgtcttggtgaactgtcagtggcattaagagaattaggctttttctgtcagtagttagtggggccacaggcatctccttgatggcttgatcttgtcaacatggtctgccgctgggtataatggatcagtctccactattttaagaattcgtgtcaggccgggtaagatttcattgtcactttgcttcggatcctgattccaagtcaaatacccaagagaattacgcctgacgttgtagcctcggttcctcatctgtgagaaagcaatctcgctttctgtcctggagaagcctgaggagagcaggggccaagtacctgcccactaaatctggtcggtaggaagctgcaacttacaggagctgctgttttcccgcctcttcatcatcaccacggtcgctgatgggtgccaaggtgatcagcatcatcttctcctgtgaaaaccagacaccgcctttctcaccttttaagtacatccaagtgtcagtcgctcagtcatgtcccactctctttgaccccatggactgtagcccaacaggctcctctgtccctgggattctccaagcaagaatactttagtacccagtattctttgtcaacatggtttgccgtgttgacaagaagtacccagttcccttctccaggggatcgtcccaacccagggattgaacccaggtctcctgcattacaggtagattctttactgtctgagcccccagggaatccagtgtgaaaatacatccaacgtgaaagttgttttagtgttttttcttttaaaaaattattccggaaattaaaaaactcaccacttgatccattctaatatgcatcttaatatgtcgctcagttcagtgtcttctccaagcttggaacagaatttattgtgatttttaaagctgtgtgccgggctttccgagtgttgggttgggtttgtttgtttttttaatagttatttgtttatctctttggctgtgccagtcttagttgtggcactcgggatcttcagtcttttttgtagcatgtggcgagtggggtcttgttccctgatccatcccggggatcgaacccagggcccctgcatttggggttcagaatcttagccagtggaccaccagggaagtccctgggttgggttttatttccaggtctcttcatgagtctctctctgacttgggcaatcacatgatctgcatcagtctttccataggtgatataaaagcaggttgcccctgccttacctcattggattgttgtggaggttatgagtcaatgtctttgaagtgggtggctggaatgagccatgcaggtatgaggtgtccacgtggcttgatggtcaaagggatgtcgcccttacccgtggctctggtttggtcctcacagctttgaagtaccataaagcatccagtgtttgaccaactgtgcagtaatagcatccttctcagcattgacctgagaccttttgggtcacatggctgacctgacccagttctgattgaacccagttcctacacagtaagaaacaaaaactttggttctgttatgtcctacttcaaaaaatgggctgagatattcccaggtgcctattttccagcattttgaaaattgctctaaatctttaccctattgtctgtttggggctgctaggtcaagttgtgtccaagaaagttctgttgtatactttgtgtcagagtctgaaagttttcactggagacctcactatcttgaaaaattgctaaaaatgtaaaattatgtattttcaatttgtatgaattatacattttattacgaaagccatcttataccatgtcagtttacaatgagtgcatgtgtgcttaatcgctcagtcctgcccgactctttgcaacaccctggactgtagcccaccaggctcctctgtccttgggattctccagacaagagtactgaaatgggttgtcatgccctcctccaggggatcttcctgacccagggatcgaatctgcattgactggcaggttctttaccatctgagccaccagggaagccccaggtaatgtgtccttatcttaaatctcttatcaattctttgctactttctaaaaataactttgtatttatgaagattttcaaacacgtgcagaaacagagtaaatactctaatgaaccccaaggactcaactcatcacccagtttcagcagtgatcaacacatggaatccccccttcccatccttacacctcggggtagttttaaacacaccccctagtgtctatcatttcaaggatatgcatctctaagacataaggagtcataaaagttctttcttaatatcaaatatcgattctgtattcgaatttcccaaactgcctcaagaatctgtttttgtacttatcgtgtttggatcacaattcagataagacagacccattcacttggttgatacttcgtaacatctgttaatatctgggttgtttgtctggtagaaagtccctttttagacacttcttggcaatagcacactgtcagcacatccctttatacacctatttatcgtgaactcatagatctgaaaagtggtcaagttagagtattttgttagttccgctttcatttacgtgagcggtcctgttactgctgcccgtcaagaggcgcgcactgtcttgctgtctccccttttgtgtgtcagatcagtccatccctgaatcgctgtgtggtcagtctgatccagcttctaaaattccccgtcagcttttcacctcctggttttagctgccattcttgaccctggcctcctgagtcatcgtttcattagcgcttcagcacccagtacataactttgaaagatttttccaaatgtgtccttcagtgggtattagacacattgaatgattgtcaacatgatttttttaaagaaaaagtgattgcctgattcaaaatgttttcacatctttatatagaaatacacatatttttcgggttgttagctagaaaaataaaaataattctaagtctcaaagataggagatgagtatgggcttccccagtggctcagtggtaaagattcccacctgcatatgcaggaaacgcaagagacttggttcaatccctgggtcgggaagatcccctggagaaggaaatggtaactcactcgtgtattcttgctgggaaaatcccatggacagaggagcctggtgggctacagggatcgcaaagagtcaaatgtgactgaagcaactgagcacagcacggggcctgagaaataattagtaaagagttggcttatgtagtacaagccataaactccaattaaagagttgaaaagtccattgtttctgagggttttttttttttttttttttagagaacacaagtgattttaaagcatttatcttccttaaaacataaggaaatcaatttaaagtactccacattcatgttgatgtatggcaaacaccaacacaatattgtaattatccttaaaaaagttctaagtgccaaaaaaaataaaataaaaaataaagttctccacactaaaggaataaaaaataaagtaccccatgttccttctgttaataatgtaaaaaaaaaaaaattaatgattaaatagtgaagttttctttaaacaaagcataatggtgatcccattttacaaaacataagggtctatactccttctaagagctgactcattggaaaagaccctgttactgggaaggattgaaggcagaagaaggggcgacagaggatgagatggttggatggcatcactgactcaatggacatgagtttgagcaaactctgggagatactgaaggacagggaagcctggcatgctgcagtccatggtgtcacaaagagtcagacacaacttagtgactgaaaaacatgggcttcccaggtgggtcagatggtaaaggatctacttgcagtgcaggagacccggcttcaatccttgggtcaggacaatgccctggaggagggaatggctacccactccagtattcttgcctggagaattccatggacagaggggcctggtgggctgcagtccataaggttgcagagttggacacaactgagcaactaacactatactccttctcattcttttacatcttcatcttgatttcagacctctttttggtgtgaaaatatttctgctttatagcttacttgtttcatagaaagtagatccgattctaaattgaattcaggaacttttgatcacgagcccaggactgtgttacagcctcatctcctggagtgtgtggtgtccttgtgaagcccagaaacatgggtccatctgatgaatttatgaccagaagttcatctgggtcttagacttaagattattaagttgtacctaggtctctggattttatatattattccactttttatgtggaataaccttcatcagaatcatttcaggaaatgagaaaagtaggatatggttatgagtcaaccttggaaaactacagcatggaatgaattagtcagaagaagggtttcagtggccaacatgagctgtgtgctatcaggaagtggcgtgactttccatgattttatgttctgcaaatcacgtggcataatgctccagacacctggaatcttttttttttttttttaagccataagttttgagataaaattgaaaaataccctggagtgaaagcacagcccttcagtaattgggcctccctactgacagctcgaatgggtttccaccccagtcccactccgtgggggatatagacatccacctggaagccctttgggtgaagcccttttgggtcaagtcagaaaagcagtcagtcttgacagagtcactgctactgaggggtgacctctgtccttttgtctctgatactttttttcatacttagtgtagctggttattaagcaacgtcattcatggtcagcaggagagttgctctcccggtgctgttctgtgttttggaagggcgctctgaggttcagaaccaggcggtgtgatctggccttcggtcatcctatttaagggcaaagggaaccttgaggaaatggagtggattaaaagtttggatcttgtaagtttcgtaaaactacctcgctagaggaaactgttgaaaacggagtcaaccaataaaactaaacacagagagaagtcagtttgtggttttattggcaatcagatcagatcagtcgctcagtcgtgtccgactagaagtcagttaaagacagtcgagagtaatcaagtcacctctgtcctctctgttaggcttggtaggtacaaataacattcagtaattacagcttgggagatagatatatagagagatagagattcagagagaaatagagatatctgtatcctccattagttgctcattcatattcgactcttgcgaccccatggactgtagcccgccaggctcctctgtccatgggttctccaggcaagaatactgcagtgagctgccatttccttctccagatatatgtacatatattttaatcagctgatctagtggaacaattcactaagaatagagcctacgcctgactgctcagctcccattgaacatcagtgagagtccagttgactctgtcgcccttggcaacctgaatgataaacattcctctggacaaaccctgttaaccaggtttgccttgtttgccatgtgtggccacctggcaagattcctgtggagaatcacctgacccacgttaactccaggacggctccatgtccctgtcatgtggtatcgctggtaacaatcaaaccctctccctccccttccagcctggaccttgctgtgtgccacagatggatactgaacaatctcccctgaaattcacacttgaaaatcctagaccccacccccatgtgacaggattaggaaggggggcccttgacgaggtggtcaggtcagaaggcagagcccccatgaatgggattaagtattgttgctgctcagtcatgtctgactctttgggaccccatggactctcacccctcaggctcctctgtccatggggttctccaggcaagaatgctggagtggtttgccatttccttctccaggggatcttccggaccccaaggatcaagctcacatctccctccattggcaggcatgggcaagcagattctttaccaccctgagccaccagggcagcacaaatgggattagtgcccttataagagagaccccagaagagctccctgccccgtctaccacgaggacacactgacaagatagccctctatgaaccaagaattgggctgccaccagacaccaaacctgccagcacctcgatcttggacttcccagtctccagaactgtcagaaaataaatttctgcaatttccaagccatctagtctatggtattctgttttagcaacggaacagactaagtcagcaggtgtgggtgtcacccggggaccttgtgaacaggcagactctgctttgctgggtctcaggtggggcctggtgttctgcatgtctcatgggtcacagctgaggccagtgctgcccactcggggccaccccgtgagtatccaggccatccagggcagcattgcataaatgaactctgtctgcagagttagcaagaagcccagccccgaagggtgtcataccctgatgctaatacctacagagccctgtgtgtccacgacctcaagtctcttgacatgacattcatacctccccctgcaggactgggaaacaccccaggatggaggaacttcacaggcacgtggcgggcgtttcctgctggcccttcagccagcatcacgtactgcgcgccatcctctgagccacacgcatggttgtctgccccagactctgcctgtaaaggcctgataattccttccctttctccagtgaccatactctttcttagtatgaagaagatttctagaacaattggttgtctaagtcttctcatgggacccatgagccctactctttttttttttttaatctatttttaattggaggatgctttacagtgttgtgttggtttctggcgcacatcagcatgaatgctgctgctgctaagtcacttcagtcgtgtcctactctgtgcaaccccatagacggcagcccaccaggctcccccgtccctgggattctccaggcaagaacactgaagtgggttgccctttccttctccaatgcatgaaagtgaaaagcatgaatgagccatatatatatgtatatggtatacctatgtcccctccctcttgaacctgcctcccacccaccctgtcccacacctctaggttgtcacagagcaccaggtggaactccttgcatcgtatagcaaattcccactggctgttttacacatggtaatatatatgtttcagtgctcctctctcgattcgtctcaccctctcctgcccccactgtgcccacgagtctgttccctgtgtcggtgtctcctttgctgccctgcaaaataggttcctcagtaccatttttctagattccatatatatgcgttaatatacagtatttttctgacttctctctgtataacacaagctctactcttaatcttcattctaagattttttttttttttttattacacccgccttgtcttcatccaccaatgtgcagggctcagaaagttcagaaggacgagaaagcatttcaactttagtggccaagggagaaacgctggacattctaccagtgacgatttgagaggtgtaagaattccttaaggctgatttaagaaagaaagaagaaagaatggtctccagggaggcccccaccctaggccctgaagcgcttgctgtatttcagagccacccattgtcagaaggtgggttttgtgttttggacttgctgaggaatcattaaatcaaagtatcagagctgctttcagctgcctctttctcccttgattgctccgatggaaatagattgaatctttcattggttattttatgaccatggaattttcaaataaaccagcaaatcgacatcattattttaagatcctaggaaatatgattcagggtttgtcatttttttccaaggaagaaactgttatagatattttctgcaagggtaaatttctgtgacttttccagttagaagccggccagcaacctttcacacagcctgtttgaaaagaaacagtgttcagaatgtaggagtaaaaatagttactcttggcttgctcgcaccctcatggatggcttcccttggtgttatgggtgcctttgaaagccatgcctctgttttccttggatctttgtttaggaaaaaaaaaaaaaagccccattccaaatgattgccaaaaatgtggcatttgaaaaggcaagtgtaatcactgtcatcaagttgcctgtcttactttatcaacatcacagagttctatggttttgcgtgtatgaatgtcttgacttagggcttggtcctggatgatggcacgatgtgagttccatcagatacacagcagagctttgcacacaccactgagtgtgtcagaagagaactggctgtacattccagtggtgacattcctgtccaaatggttttcttccagtgccttttccttgaaaacattcaggcaaactgtagataggaatttgtgcttctaaagagactttatatgaggatttttggtaagagtggttatatggttgtgtgtgcacgctcagtcatgtctgactctttgcaaccgcctggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacaccatatccctagctccctgaaggccccatctccaaatacagacacattctgtaggttctggggggttaggacatcaacacagggatttgggagggaatccaactcagcccataactaaggtctttgaaactgcaaaattatttcttaaacttggattcttttgtattctgtccactccttttcaagaatggtcctatcagcatctcagcagggggacggcagatctggaattttaccatggaagtaagaattgcaacagcaacctcgttctccaagtggtacttctggtccctgaggagggctttactctaggagaaatggattaggatagacgtcctgaatgctccatgggtaacagcatggacctctgccgtttcggagtcccagctgtgcttcctccctgctccctggcccacctcgccatagaggctgcaggatttctgggggtcagccctcagacgaacccctggcttctgtgcccaggagctcttggggtcagtgcggggggtcaagtctaccctgggggccctgccagctcctccaagaaccacagtagagtcatatctgggcccccggcagtgcctggcctgtggcagatattccccaaatgggtgaatttgagaaacatgtcagccatgggggctactgacctccttgtcctccgtcacgccctccacgccgcccagtctgtttagcggcagaggatcccactcgtggagttaaccatcaccctttgctttgggtaagttgggagcaaggcggtatggagcagtcctgtttcaacctgggctagaggagagagtattcattttccaaatctacctccacaatgggtcctctgggggtttagctgcccaccactaacactgattttgagcaaccacagcccgtcctgtaacagttacatctttaaaccacctaaaccaccaggtgccaaaatgaacactgttttgaagaaatgaagataataattacactgagttataggctgtccgagaaagtgccctaggggcagatttcgccgttttgaacataggctaccaaaaccatgactgctgggcacctgactctagccttttgcccagaaccttcaacagccactgacagcctgagtcagaaaacgccaggacccaaacagggcaggcatgaacacggcgcattagtcactggccaacacggcttcctttcattacataggatggataccgtaacgtgcatgcgtaacagaagagatgcgtcagacacacctagtgggtcatatcaccgcatccggcaaacgaaatctcacagtccccctcccggctgttgacaacagggcagttcatttggcagtgcctgtcagcaaaatcaccgaacctagacgaaataagaaacaagctcacagaataagcacagggaggaaaaaacatgcatttctttgcaatcgctttatcctgtgatagtcctttgcttgaatttacaatataaaacttggaagaaagttttctttagatgacacctagacagaatttggggcttcccaggtggcgctagtaaagaacccgcccgctaatgcaggagacctaagagatgtgggttcgatccctgggtcaggaagatcccctggaagagggcatggcaacccactccagtattcttgtctggaaatcccatggacagaggagcctgtctggccacagtctatagggctggaaagagtcgaataggactgaggcgacttagcacatacacaagacagaatttaactttcttctgccagcccacagcattagtagatttactaaaagatacagacattcataacagctttttaaattattatgagtaatatttttcagtgaaaacttttatttctcatcatgtttagcaaaatatcaattgtatcacactatagttaaagacaaagattctgatgccgtaatagtaattaaattataaatacataagtgttgtgttcaaatgtactgtgcttgactcgctgatgtagagcgtgagctagtggtaaccggggggagagggaaggggaagcggaatataaaggtaggggagtaagaggtacaaactattaggtataaagtaagctacaaggatatattgtataacacaggaaacagccaatatcttataacaactataaatggggtataagctttagaattgtgaatcactatcttatacacctgtaacatataatattgtacagcaactatacttcagtttaaaaaaaaaatactatgctcctatttcaaacgtttcaatagtgcataaaatgtaaatcctgagcgcgtactgacttaacctgtttgaccacttttatccttttgaagtctgcactttccaaagtttacatttgaaatctcagctttcccagtcttaagaggtcacttcagagcttttgcaggaatcagatgtcattttattaagagaactgacttgactattgtatgttttctcagaaatctgaatcatccagctcacatctaaccttgcaaaacaagtttcctatgtagttttgaaagcaaacagtaccctgtaattaaaacacattgaatgtcttaatccagtgtttctcacaaagtggtaaagtgtagttcttaggaacgtgagcttagaactcatagacttcggttcacaatcctggttccaaagctgacagatagggagtcttcttagctcagttgataaagaatctgcctgcaatacaggagacccaggtttgatccctgggttgggaagatcccctggagaaggaaaaggctacccactccagtattctcgcctcgagaattccatggactgtatggtccatgaggttgcaaagagtcagacatgactgagcgactttcacacttcacataaattaatcacctgaagtttctcacaaatatgactgacttaaactagacaccatgaaaatgctaccgagtccactccaaataattagctcatctccccaagtaaagaacttctacaggaatatggtagtgaactgtacgtactaatttgcttcagtcatgttcaagtctttacaaccctatggactgtagcctgttgggctcctctgtccatgggattctccaggcaagaatactggagtaggttgccatgccctcctccaggggatcatcctgacgcagggattgaacctgtgtctttcatgtctccagcactggcagatcatactgctgaaatgaaattccacagtctggatgccttaaataacagacatgtatttctcacagttctgaattctggggagtctggggtcaggtgcacacatggtgcaggttctggtgagaactcccgaaagcccgctggcgaggcttgaaggtgattatcttcttgccatgtcctcacgtggcaaagagacagcaaactctggtctttgttcctcttgatagcttttttttttttttttttcttttttggctgcaccacatatattgtcactgtgcttatttaacttacatgcagagtacatcatgcaaaatacaaggctgatgaatcccaagctggaatcaagattgccaggagaaatatcaataacctcagatatgcagatgacaccacccttatggcagaaagcaaagaggaactaaagggcctcttgatgaaggtggaagaggagagtgacaaaactggcttaaagctcaacattcaaaaaactaagatcatgacttcccgtcccatcacttcatggcaaatagatgggggaaaattggaaacagtggcagattttattttcctgggctccacaatcactgtggatggtgactgcagccacaaaattaaaatatgcttgccccttggaagaaaagttatgaccaacctagacagagtattaaagagcagagacatcactttaccaacagaggtcagatcagatcagtcactcagtcgtgtccgactctttgcaaccccatgaattgcagcatgccaggcctccctgtccatcaccaactcccagagttcactcagactcacgtccatcaagtcagtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggctgatgtccttcggaatggactggttggatctccttgcagtccaagggactctcaagagtcttctccaacaccacagttcaaaagcatcaattcttcggcactcagccttcttcacaatccaactctcacatccatacatgaccacaggaaaaaccatagccttgactatagacgaacctttgttggcaaagtaatgtctctgcttttgaatatgctatctaggttggtcataactttccttccaaggagtaagcgtcttttaatttcatggctgcagtcaccatctgtagtaattttggagcccagaaaaataaattctgacactatttccatggtttccccatctatttcccatgaagtggtgggaccagatgccatgatcttcgtttctgaatgttgagctttaagccaactttttcactctccactttcactttcatcaagaggcttttgagttcctcttcactttctgccataagggtggtgtcatctgcatatctgaggttattgatatttctcccggcaatcttgattccagcttgcgcttcttccagtccagcatttctcatgatgtactctgcatagaagttaaataagcagggtgacaatatacagccttgacgtactccttttcctatttggaaccggtctgttgttccatgtccagttctaactgttgcttcctgacctgcatacaaatttctcaagaggcagatcaggtgttctggtattcccatctctttcagaagttttcacagtttattgtgatccacacagtcaaaggctttggcatagtcaataaagcagaaatagatgtttttctggaactctcttgctttttccatgatccagcggatgttggcaatttgatctctggttcctctgccttttctaaaaccagcttgaacatcaggaagttcatggttcacatattgctgaagcctggcttggagaattttgagcaatactttactagcgtgtgagatgagtgcaattgtgcggtagtttgagcactctttggcattgcctttctttgggattggaatgaaaactgaccttttacagtcctgtggccactgctgagttttccaaatttgctggcatattgagtgcagcactttcacagcatcatctttcaggatttggaatagctcaactggaattccatcacctccactagctttgttcgtagtgatgctttctaaggcccacttgacttcacattccaggatgtctggctctaggtgagtgatcacaccatcgtgattatctgggtcgtgaagatctttttagtacagttcttctgtgtattcttgccatcttttcttaatatcttctgcttctgttaggtccataccatttctgtcctttatcgagctcatctttgcatgaaatgttcctttggtatctctgattttcttgaacagatctctagtctttcccattttattgttttcctctatttcgtatatctaatcaaagccatggtttttccaattgtcatgtatggatgtgagggttggaccaaaaagaaggctgaagtcttcaatatatgaaattggggtggggggcgggggagatacaattcagtccatagcagagggagagatacttagttttatctcattctcctggccctttcatgacaaatttttactttttctgctgggacttttcccagattttctgtatctgctgggggtgtttgcctacatggcaggtaagggtctaagtgtggagatgatagatcatccaggaaagcttttcttttggctcccctggaaacgtccagatctctcagggtccctcgtgcctggctcaggtcctgagatgccagctgctagggaccctagtccttccctgacaccatggccccttggttctgggagtggcctgcctgcagcctggtggcagcctttctgtgacccttttggttccaaacaaaacacaccacccaaacccactgtgctgctcactgtgtggatgttttgaagcaaggatcccaacagagaaggctgtgggaggcgttcattcatgcagacatgtccctgtaatccagaaggccattttcactaagtcacgcacttgtgactcatcatttctccaccttttcaattttccagataggacattgtaatggggcaaacgatttatgccttcctgtttcccctctcagtgggaaaaaagacactctctttccatatctaaaatggaatcgaatacttattgtaacatgtacatctcaagggaaaacccattgctattttgaacctgcttcctcttattcttcagttcctgaaacagtggatgttgcttatgtcccctgacttctacttactgaagtggtgggttacaataacttagttgcttattagtgtttgaggaccctgtgtttatcttcaaactttaaagacagttttaagctacaggtggtttttatttcatgttcatgtgtgggccacctgcagacaatttgtgaagaactgactcattggaaaagaccctaatgctgggaaagattgaaggcaggaagagaaaggacaacagaggatgagatggttggatggcatcacagactcaatggacatgagtttgagcaagcctcaggagttagtgatggacagggaagcctggtgtgctgcagtccatggggtcacaaagagtcagacatgactgggcgactgaactgaactgaactgtagacgatatattggcattattgggattcttttcaaatcttttaatgctcaattattgcagtaagtgctttgtaagtgaaagcgtacttagtttgaagcaaataaaatggtttttatgtttaaagcaaaaccaaacctaatggaaaggaagaaacagtgaacaagttactgaatcaggatttttatgtcatgtcctgttagagccaaaatttagtaagttctccgcctgctagcaaatgtttggagctggaggttgttattaggcagagttttgggggatttttgaatggaaaaaagtaaacttttgcctgatgtgatttctaggcattttctgagtcacagaaatgtttgttgttatccgttttatttctataagtcactttcttttaccactcttccgatgatccaagagcatgttgtatctctgagggatgtcatcttattcaagacacactgaaatctcccaagttttccgtgtgttcaaccaagcagttgagacttggacaatatctcctttggacccatttgaaatgacatgttccaaaggaactctctgttaaaagaggtcattgtttcctgttggacaggacattaaatgaatgtgtttggcctgctggggctgttcttagaacattagaacaaatctgcttgagtttagatcccagagttattatccttccaggaacgtttgtaaatcgtgggcgacatcgggcttgcagaggtgtcagggagtggggcgggggcggggagagctgctggccttcaaggaggagtccctgaaacagtctagaatgtaaagagcaggaccacatgggaaaattcatttcatccaaaacaccctgtttcatgggcatatacattagtcaaacttgtcaaattgtacatttcaaagatgggaagtttattatatgtcaataaagttgtttattgttgttggtcagttgggtctgactctgctgccccacagactgcagcatgccaagcttccctgtccttcactatctcccgaggttgctcaaattcctgtccattgagcaagcgatgccatccaaccctctcatcctctgttaccctcttctcctcctgccctcagtctttcccagcatcagtcttttccaagaggtggctctttgcatcaggtggctgaagtgttggagcttcagcttcagcatcagtccttccagtgaaaattcagggttgatttcctttaggatggactggtttgatcttgctgtccaagggattctcaagagtcttctccagcacaatacaattctttggcatccgttcttcagccctcagccttcttcatggaccaactgtcacatctatacatgactactggaaaaaccatagctttgtactaaaaaaaaaaatgagtgtaaaagtcctgagaaatgctgagacaagccataggctcccttgactcttaggacataaaggatcttcccactcaacacccgccgcccccaagtccttcacaggggggcagactgagtgacctcatctcttttctcagtgttctttcacccatgtcccacattgcagcagctttcatcagaaaccacaaggagcccaagatatacttcctcatttgcaaaatgaccttataagtcaggactcagatcggttctcagtgggacccacactcacatatgtcaccagcccagccttttgttggaaaatacgaagttgcagttcagatagtcttccggctgggcttcggaagggtgggtgacatgtgctgaccaggcctgctgcccactgtgcagtgctgtggtctccccaccccagagcaggaagcaaacttgaggagacagtgaaacaaagccagggtgtaggggaggggtgctggtcttgtgactttgcttagctcttgcctcctggtttagtttgtgctccactgagaagtcagggggtgctgctgaaccagattgcaggcaccccggttgcaggtgcagggcaggggaaaggtggtcccagcagctctcacaccattgacggggggccggaggagaagcttcgtccacatatcaagtgcctccatcttatctcactgccccctggccttcagggatgcgccatggtgttcacatggcccagccttatgaggcttccccactcccacccagtggtaccctgggctcgccttctgcgcatgtcactggtgctgctgttggctaagacgtaaaggatagttccagggagtgagtgctaagtcgcctcagtcatgtctgaccctttgtgaccccatggactctagccctcctggttcctctgtccatgtgattctccaggcaagaatactggagtgggttgctgtgccctcctccagtgggtcttcctgacccagggatctaattggcgtcccttacgtctcctgcactggcaggcaggttctgtaccactagagtcacctgggaagccccccagttctaagtgaaagtcaaagtgttagtcgctcagtcatgtccaactctctgtgaccccatggcctataacccaccagactcctctgtccatgagattctccaaggaagaatactggagtggattgcccttcccttctccaggggatcttcccaacccaggggttgaactcaggtctcccaccattgcaggcagactctttactatctgcgccaccagggaagctctgatggaaagtggatgtttccagagagcagggcagtgtctccttcacttgctctctctcagggactagcatgtctcctcctcagaagatgctcagcgaaaaagcttgatgaatgaccgaggaaaggaaccccaaatcagattttcctccactaatttacaagttttaaaagtgccaggtatctttttctttcctttttttcccctaaattcctcttttcagttcaatattttggagtttacagagaacacgatcatgaattcattcagtcactcagtccacagagaatctgagcagtctcccaggatccgggacctgggctggatgtggcaggcagcaggaagatcactttccagtcctaaactccagaccagttaccgctgtcaacgtgtgctaggaatgaaaaggagtgcttaacagaggactcagccatgtccaaggggcagcagctctgaggagtcgggtttctgttgtttttcacgtgggactcagacttggagcagacatgggaggcagcccagcagagagctgcctggataaaggtcctgagacgtgaagacctgaccggggcagcaaccatgaaccagggcagtggccggaactggcctgcgtcgcgggtgggacttgccccaagagatggcaggaaccacttgtcacgaggctgggtttttctcctgagggtgaatggaggccataggagggctcacaaggagaggacaggtgggttcttaacacctggcttgggaacatctcaaagaagagtgagccgtggtgcgttctctgaggctcaccttccagcatccttcccccatgcttcctcctccctgtgctccaggtcccatatgcaaagcatcctgcagcgaactgggcggagcttccagccgtcccttcagataagcaggctgccctttttattgttcagtcactcggttgcatctgactctttgcaacccccatggactgcagcatgcctggctccactgccctttgctatctcctggaatttcttaaattcacttccattgaatagtgatgctatctaaccatctcatcctctgccacctcctccttctcctcttccttctgccttccatccttcccagcatcaggatcttttccaatgagtcggctctttgcatcaggtggccaaagtattggagcttcagcttcagcatcagtccttccagtgaatattcagtcagtttcctttaggatggactggtttgatctacaacatggccaaaatgaaataaataggttagagaaagataaaccatgtgaacactaatcaaaaaaagacaaatcagaaaagctgggagaagtgagaagggtgcagaaggatgaactgggggaagatggaaccagggacagaggcaggacaggtgcccccacctctgtgtccctgtgccaggccctttcctgagccctggggtgtgactttaacagcctcacagccaccctaggaggtaggccctgcttttatagttttggaaactcaggtcaacctggccctgcttgcagcccctcggaagatgatgtgtggtcctgccttccctggccccacttcccttaggactttccttctgtggctgttttatggataatagctccaactgccctgaactgttaggttgaaggaggaaagggaagattgcatggccccccttgtctggtatttgcagaatgtctaatgatctgtctgatgttccacctgaaaagggcaagtctggaacattgtgtgtgtttgtgtgtgtgtgctttttaaaactttttcaaatgcagcagaggagcagaaagactcttggaatatatgctaggacagctgcagctgatgcttaccacatctgaagttgcccaatctctgctgggtgggccccttgtggacaccagaggtgctcaaacttgcgtgtgcattccagtcacctggagggcttgttaaaacccagagcttcggattcagtaaatatattctccgctgtgtaatgaaataccacaagtggaatggctcaactcaacacccacttattagctgggaggtctggagtcagaagtcagggtgtgtagtcaagagtcggggtgtggtgtggccagtttctctgctccaggtcatgcaagactagcatcaagtcacgggtggggctgccttcctctttggaggtctggggaagaatctgcttctgcagatgctcagatccccatttccttccaaggccaccctctcctcttgaggcaacttacatcctgaccccttcctctgtcaagccagtgacaagggatctctctcacatgtcaaatctctgacttcagaaagagcctggtctcttctaagggctcagcctggctaatcgccttttcacaaactgtgtggtgtgacactggagagggaaatggcaacccactctggtattcttgcctggagaatcccatggacagaggagcccaacaggctacagtccatggggttgcaaagagtcataagccagtcatgggtaaaacccatcgtggccatggtcctggagacaatgttatgcctggcatgtccaccggggaagggggacagtgggccattttagaattctgtctggtacagtaggtggggcaaaactgtgcacttctaacacattcccaggcaaagagacgctgctcctttgaaagtacattgtgagagctacttacttaggctaattgtaccacctttgacttttgtagttgttgttcagtcactaagtcatgtctgactctgtgaccccatgggctgtagcacaccaggctcccctcttcttcactgtctcccagagtttgctcagactcatgtccattgagtcggtgatgccatccaaccatcttatcctctgccacctcccttctcttttggccttcaacctttctcagcatcagggtctttcccaatgtgtgggttctttgcatcaggtggccaaagtagtggagcttcagcttcagcatcagtccttccagtgaatattcaggaccgatctcctttaggatggactggttggatctccttgcagtccaaaggactctcaagagtcttctccagcaccacaattcaaaagcatcaatccttcagcgctcagctttctttatagtccaactctcacatccatacatgaccaatggagaaaccattgctttgactagatggacctttgttggcaaagtaatgtctctgcttttaaatatgctatctaggtttgtcatagttttccttccaaagagcaagtgttttttaattttatggaagcagtcacctttgacttagattgtgcctaagttacagaagagaaaattcagttttacatctagaggtaatgttcaaaatttatagcaactaggaccttgtgggcactgaccagtcagaaaagatatccactagtcagggcagatgctgtcagtgtataaccactgtggtcttcctgggtggcacccactgatggaagaatcccagcaaacgagggctggagtctgtgcttatatcagagctgggactttggctactccacaagctaagattaaagaggaaatgtcccaacaatgctaagacaggaaaagaggaatcaagagatgtcttactgattccaaaattgattcatcttcagttgattcatcttcttttcattctatgtactccatgttctataatctccctcaaggttaaaatctggatttgtttcctatttctgctgtaacaaactactacagttttagtgcctgcaaccacacaggtttattatcttacagtgctggaggtcaaaacgccaaaatcactcagtgggctaaaattaggagttggtttccctgccttttttcaagttctagagtcgaaagcattggttcataggctcacatcacttcgaccttcttccatcatcatatcagggtccaactccaaccttcctgcctccttcttactgtccccggacaatctcaaggtcatctcccatgtcctcagtttagtcacacctgcaaggtcttctattatctgtaaggtcctgtgttcagagtcccagggattaggatgtggatgtctttgagaggccagtcttcagcctgcctctctatgcaaggcccagagttacgtggatcacaacagcagacactttcctagaacttcctctgcgccaagccctttttagacgttaggttatgaccgtcacaacttatgaggatggttctgttgttatgatccttcttttacagacaaagaaactgaagcacatgggagtgaagaaccttgtccaaggtcacacagctgagaaatgtcaatgccagggctccaacccagacagcctggctccagagtccatgctctttcccactctgttacatccttcctgtccatggccaggtaaaaagcggccactttatataaatgacgaaaaaccagagtcaccttcccaatctcaacctctaacctaaccatccatcctctgcctctccctctgcctgtgaaggatcctactctcagtgggaaagcagtccatcggttcagtctttccttccctgccatccaagtctaatcaattacagagacctggccatttccacacatctctgaaacattcttccagttcctatttctgggaaacaaaccaccccacagtcagcggctgaaaacagcagcagtcatttattttgctcaggattctgcagttccgccgaggtgactcttctcgcctccacatggcgtctgctgggtttgcctggctggatgccggggaagccactccagatgccacactcacacagttggcaagttgtgccagctcttgtttggtagctcagccagggctttgggccaggggcctcagttcctctccacgggctgcctgggcttcccgacagcatggtgactggtttccaagagaacaaggcatgagtgcatggccttttatgctctagcctcagaagttatgtgatgccatttccaccctatcgcgtctgtggttggtgttcattcactacgtcgtgtccatctcttagcggactgcagcctgccaggctcctctgtccatgggattctccaaggcaggaatactggagcagatttccattcccttctccaggggatcttcttgacccagggatcaaacccagatctccttctttgcaggcagattctttaccatctgagccactagggaagcccctagtgtctgttgagactctcacaaaggctcacccatgttcaaggccagaagagacgtaactgtcctcttggtgggggaatgacaaggttctacaagagcatgtgggaaggaagatttgtgacagctctcttcagaaaattccatctgccaaaaatgtctttatagtagctctctgcatcctccccacattgatggatactgtattcaaaaaccccagattgggtctgtgaactaacagaagatcttgtctaataagttcatttattttgatatttttaccaaaatattaaaaatgtagccacatgtactgcatggttgttttgtattttagaaataaatcaaactaacaaaagtaggatttcccgagaaatccaggacatcagactaataaataccaacacttaaccaatgccatgccaaaatacaggcattcaagtttcttcaaaatcacactgtttatgtctttaataaaaagcaactccttttttgagttggcatgattgtggatgaagaaaatgttaactttcctaatacctttgatgctttcaaactgtggtgctggagaagatttgagagtcccttggacagcaaggagaacaaaccagtccatcctaaaggaaatcagccctgaatcttcacaggagggactgatgctgaaggtgaagctccaatactttggccacctgatgcaaagagctgactcactggaaaagaccctgatgctgggaaagattgagggctggaggagaaggggacgacagaggatgagatggttggatggcatcaccgactcaacggacatgagtttgagcaaactccgggagacagggaaggacagggaagcctgacgttctgtagtccatggggtcgcagagatttggacgcaactgagccactgaacaacaacagtaccttatattcaggtagtaatgagaaaatacagggctatatccttttccttctcatttaaaaatctaaccctatttttaaggccttaacccacaggactttccatagctgggctaattgggtattgagacaggatcatcactgatccctacctccacctccaatatcctgagctttcactgcccgcaacacagatggctcatgtatattatctcatcactagagttgcagtctcatctcacaggctataatattaagcccctgtgatggcaggaactgtgtcttaggcttctgaacccctcacagagtactgtgtgtgtgtgtgtgcctgtgtgttggtcgcttagtcgtgtccgactctttgagaccccatggactgtagcccactaggctcccccgtccctgggattctccaggcaagaacactggagtgggttgccatttccttctccaatgcgtgaaagtgaaaagggaaagtgaagtcgttcagtcgtgtccgactcttagcgactccatggactgcagcctaccaggctcctctgtccatgggatttcccaggtaagagtactggagtggggtgccattgctttctccatagtttagtggaggaaaccaactaaaatgtgattaagtgaattccctggcaatccagcggttaggactccaagctctcactgccgagggcctggggtttgatccctggtgagggaaataaactaccagaagctgtgaggtgcggtcaaggatatgtgataaatactaaacactggaggttctcggtgttatgagactatgtggtaggtgtaatttaacccagccatggaatctgagaaggctcagagcagatccttaataaatggtggttgaacgatcaacaaatgaggagttttcttcaaacaaggaaatctgttcttaattccaaacagcccacacaagatgctgctcagcgaagatgcttgaaaaataatgtcttatctgcaggtagggaaacacctgctgctgctaagtcacttcagtcgtgtcccactctgtgcgaccccatagatggcagcccaccaggctcccccgtccctgggattctccagacaagaacactggagtgggttgccatttccttctccaatgcgtgaaagtgaaaagtgaaagtgaagtcgctcagtcgtgcccaactcttagcgaccccatggattgcagcctaccaggctcctccatccatgggattttccaggcaagagtactggagtgggttgccattgccttctccagggaaacacctagctctgggaaaacccacctgtccaaggaattttacgctgtaactgacttgttgcctggaatttccctgttagtaatgcattcacttctgactgagactttgatcttcagaagttgatgattaaatccaaattctcgggcaggtcttatacattaaacagttgtcattgtgaacacagtcacggggaaaggtttattacgtaattccagtcaaagctatggtttttccagtaatcatgtatggatgtgagagttggactataaagaaagctgagcactgaagaattgatgcttttgaactgtggtgttggagaagactcttgagggtcccttagactgcaaggagatccaaccagtcattcataaaggaaatcagtcctgaatattcattggaaggactgatgttgaagctgaaactccagtactttggccacctgatatgaagaactgactcactggaaaataccctgatgctgggagagattgaaggtgggaggaaaaggggatgacagagcatgagatggttggatggcatcaccgactcaatggacatgagtctgagtaagctccaggagttggtgatggacagggagacctggtgtgctgtagtccatggggtcacaaacagtcggacatgactgagcaactgaactgaactgagtcttgttagaagggagatgcagaaggcaggattgtctcaagaagaaaggaaaagattggatgtgattctggaacaaaaggacagagggaaaaaaaaaaaacaaaaacgcagctgaggaagcaataggtgtggagacttggcacggacaggaaagagctctgtagttttgctctgagaagacattgccctgggggacatttgaatgacctggatgggagatctttgccccacaatcagatattctgtgctgaccatactgtggagcctacagaacgtgtgaggtctgctcagcccagcgactcacactgtggagccaaatagaatcacaagaccctgttctggccagtgcatggccttgattccggggagacaggctcagtccacacactttggacatttcaccagctaaagagggctggctggagaccttaccaaaggtaaaccaaatgaacattttctggtgaaatctgtttgttaaagatatttagattagaaatgggattcttcccacagttgaaacttccaaatattaatgaggtaaaaacacaaggcttgggaataatgaagtaaaggtcatgacaccagtgcatgcatgcatgctcagtcactcagtcgtgtccaactttttgtgacgctgtggactgtagccctccaggatcttctgtccatgggattttccagaaaatgggttgccatatcctcctccaggggatctttccaacccagggattgaacccgcatctcctgcatcttcggcattggcaggtaggttctttaccaccgagccacctaggaagtcccaggacaccagactgctatgttaaaaaaaataaaagtagatttcctctctaaccttctgccttacttagtgtatctgttaaccatggtccttgatccaatattgatatagaacagatagtggggagtgggggaagagaaaagcctttttttgttacaaaaataataaatgtgcattgtagaaattctaataagtccgaagaaggaataaaagaaagcactgcagtctttcttttcatcaagatgaagtcacaacagtaaacactgctttgaaaactgggttttttcccccctctaaatagcaagttgtgaacatcttttttatgtcgttaaatagttttcacttccttcctgtgaggtatgagtggctctgtagtgtactgctgtggctgctgctaagacacttcagtcgtgtccgactctgtgtgaccccatagactgcagcccaccaggctcccccgtccctgggattctccaggcaagagtgctggagtgggctgccatttccttctccaatgcatgaaagtgaaaagtgaaagtgaagtcactcagtcatgtccaactctttgccaccccgtggactgtagccttccgggcttctccatccatgggattctccaggcaggagtactggagtggggtgccattgccttctccggtagtgtactgatacagcatatttattagctggtttctgatcaaatgattagtttgctctagtgtgttatttgcataaagaacagtgcagagaatgtattttcatcgaaattttttcccacagccctgaggatttcattaggacacctcccgggagggattcagggttttggttgaccttgtttatactcaaagtttaaactgttgggtttacctgtggcttcccaagtggcgctaggggtaaagaacctgcctgctaatgcagcagagatgcacacgagatgagggttcaatccccaggtccagaagatgccctagaggagagcagggcagcccactccaatattcttgcctgaaaaatcccatagacaggggagcctgacaggctacagtctgtagagttgcaaagcactggacatgactgaagcgacttagttcatacagttcactaccatatccttcagaagttctttacctggggagatgagctaattatttggagtggactcagtagtattttcatggtgtccagtttaagtcagtcatatttatgagaaatttccggtgattaacttatgtgaagtgtgaaagttgctcagtcatgtccgactctttgtgaccctgtggactatacagtccatggaattctccaggccagtacactggagttgctagcttttcctttctccaggggaccttcccaacccagggattgaaccagagtctcctgcattgcaggcagattctttaccaactgagccaccagggaagcctggtttgttggtgggttgagggacacagttacacacccagatcccttcaggagtgatggatttgtccccgagctgcccttgtcagttgcccccttttggggctgagttcagctgagagccacctccctaagtcccctccttctcaaggtacctcccatcccagagctgaccaatgcagagggtatcatggcccagcccttctgctccagtgagggtcgtcccatcttcagaactccccacagggtctgcaaggcttccactgggaccacctggtagctccaccctccctctgcctagcctctctttctcccctgcctttcccctcccctcccacccctcccatctccttcctctccctgggtgttgatcaccaaagaaagtgaaagcgaaagccgctctgtactatcttactctttgtgaccccatggactatacatacagtccatggaattctccaggccagaatactggagtgggttgcctctcccttctccaggggatcttcccgacccagggatcaaacccaggtctcccacattgcaggcggattctttaccaactgagccaccagggaagcccaagaatactggagtgggtagtctatcccttctccagcggatcttcccaacccaggaatcaaaccagggtctccggattctttaccagctgagctatcatactccctaacaaacctcctgcacgataacctgtgtctcagagtccaggagcagccagtgactgttggggttttggttggttgtcgggggggttggttacaggagcagaagtaggggctcagccaaccctggccacagatcgctgagtgtttcatggaatttcacccccacaaggggagcgctagcaacaccacagcctctggggcagctcacactcaaggatgaagtcaggctccctcttactaagagtccttttcacataagaagatggatcaaactgtatcggagaatcttacaagaccactttaaaacactgtcttctcaaaaggatcttttgaaacgtatctttaaaagcctcaccctgagaatacccggatctcaagctacctctagatcatctttctaactcgtgttgccgaatatcggtggtaaccaaaaccttccgtctccattcatctataaaccagttctgcagaaatccatcagtgctgattctcagctgtgccatgcacctccctggtatgtcccaatcctgtcttccctaacaattgctaaagaaaccaactgtggtttgtaaacgtttgcgcggaatctaggtcatctccatactagcatccccaccattcacttgcataagagtataatttcaggagtgaagagaacatactgcaaatgcccagggagtcatgcctagaaatgcgatatgtgtcagtaaaaaataaagaattgctgtataaggaggaagggacgtgttctcactgtgtattatttggagtaattatttgacatagaacattttgagcctggggatgtggacgggtaggctgctttgtgtgtccctacctctcagtgtctggctcaaagcaggtgactaatctattttgatgacttactaaattaagccagaagccaaaaactcatgcctctggggtctggagcatggagccgttggtatttgaagagcaggggctttgccacgggtttggccattgctgcatgagtgtctgggctctgaattgccacatcttcctttttttaaaaacaaaaatgttgttttttatttttttaataccaaaaacattttgtgttgagtatagccaattgacaatgttgtaatcgtttcaggtgaacagtgaagggaatcagacatacatatacatgtatccatctttctttttttttaatcccccccccaaaaagaaattatatatctctgtgaaaactcccaattttttaatattggcaactaatagttttattttggggaagggcactgccagttcacaaccagcaaactaacctgaaggagaaaaagcagctcttttcagatgctctggtgtagaggggtgtgcacatttcaagtcacttgacataaacaccccagccttcctaatgaacaaggttggcatgactgtccttgttttttcatggtgactggcaataaccaagatgcgatgtcttgtttgtcctgtgtttattgttgtgaagtctgtttcgaatcattgtgatacccacacggaggtgacaggatagacttccacaggcgacttatcgtcagattttaaaataatcctcgatgatgaaaatgcgaagtgtgaaaagacagcatgctctgtggtctcctgggtaacttcccaacaaagtcgtggaaatggggcctgtgggtggtaatggaaagagtagataagaacacataatgcttttctcttctccctcacttggcaaaacatgatttctgagctgagatcctgagatttaaaaccaggtgcggatacaagttctgcgaagccaagttattgaaaactgagttttgtctctgttgttaaagattgacagatttcggtctgacctcattccttcccccttagtctctcttgacctttgattcagccagtcaatcacccagtactgatggggtgtctgtgggcccgcagacctgtgccaggtaccctgggagaacttaccagaaccagaataggatccgggccggccttgaggcagcgtacttaccagccagagtttgagctgtgtcagttcttccaagatgagtgtggaacatagaatgagacaaacaaggcttttccaccagcattcacacgacagcgtcaaactcatcatttgaatgtaaagggatttactgggtgggaatgaagtagtctaaggttgtaaaagccatttggagctggaatggaaaaaaaaaaaaaaccaggtcctggggactgaagaaggcttcccgggtggctcagtggtaaagaatccaccagcaaatgcaggagatgcaagtttgatccctgggtcagggagatccatcccctagaggaggaaatagcaacccactccagtattcttgctgggaaaacccctggacagaggagcctggcagtctgcattccaaggggtcacaaaagagtcggacacaactcagcgactgagcacacacgcatggtgactgatggacacaagagcagcctgtcgccagcccacccctgcacaactgttctgtccaggtttctgtcaccacggggttgtgccctggcttgagaacagcctcaaagcaaaagtgaaaatcaatcattaaagcaaggtgtgtctggaaaggaacagactaaagagagcaaataaggaatgattagttagtgtggcttgggccccagtcatctccaaataaacgctacctcccttaatccaagtcatcaagtgtagtttagatttgcctatggctatttctccatctcaagaattgcaaacagtaagtttccaagaaataacagaggggtggttaatcttcacgtcttaatgctaaggaaagattgaggtcataagggaaaaagttaatgggatttcaagtgcacatggaatttaacaagcaaaatgaaatctgggatgaactgtgacctgtcttttaaggtataggtttgaacatgcttctctctacttttccccatcggttattttattttactttatgtctttcctttctttctttttttggggaaggggtgactgcatgcttttctttatttccacataaactttaacagagcatgattgctgtttggctaaaacacacctctagcattttcaccactgcagccgtcacttttggctaaaaagaataagaagttctatgacatcccagaaatacaatttatttgtacactatcttatactaatctatgaagagcatcaaatgatatttcaggcttttccagttttttcccaaagtatcaaaaatgaccaaagctgaaatttagttttaacacattactgactgggggattttggcagaaactaacacctgtggtgtgaacgcatctccagtcaataatgtgttattgtttcttcgtgttgtcgtacagattcagaagattaatggttatgaaacatgaagatgattttcattaaagagggttttcttggcccagatttagaattcataggtgtcatcctctgcagagggaggcgagcacaccctctggtctaagggtttctgtctgtgtgtgtgtgtgtcctcggtcactcagtcatgtccgactctgtgtgaccccatggactgtagccctcagggctcctctgtccatgggatttccccagcaagaccactggagcggggtgccatttccttctccaggggatcttcctgactcaaggatcaaacccatgttcccatgtctcccgcattgcaggctgattctttacccagtgagccatagagtaagttctcttgcctaaggggttctggttagagccttccaagtccatcacaaaaacggctatcagtatcagctctgtcttacatttcctttctcgcaaaggcccctcgctgtggccaagcagatcttaccagtcacaaagcaattccatgagcaataaatttctgagccgcatctggctcctcccccctcccctacccatcccccccattacccctcagagataacaaaaatggaaagaagagaagtttttgttctctttttcacatgtgatcatcacaaaaaaagcaggttgggaatttaaccacactacggggagacaataggtctccaaacatttttgatcatgaaccttgtagataaaagattttttttttgataaaaatttttgagtgcaactgccagtaaaagcatttaatttgtaaattctagacaaattctactctacactgtataccttaacaaaacacaccctaaaaactgacattttaaaaaagacaagtgaacatctattaaattgttcactttccacccaaatgccaaaggttggtgagaccctgtctgtagacccctaaggagagtcacatgcctctgggagtgtctatgcaggggcctcagtctagagctggtggtgagctggtggtgcagcccctagcccagacacctacgagccactaagctgcaaggagggaggaagagcaccccagaatgtgagcgacacccactgagcaaatgtgtgcctttaccacctcctgcagtgaaaaggaatggcatggtctttgtttaaaccaaagacacgggacaccctccagttaggaacacagatggctgtggctttttgatggctggtggatgcttgtgtcagatggaccatccctggtgaagtcttgtagggctgccaggtaagaatataactagggtatcaggctgactgcatggggtgcctgttgtggggcaggggcatcaccaggattaaaggtgggagagaacatgagccctggaggggcacctcctagagaaggggtgttcaatgatgggctttgaaggataaataggaattggtaggcagagaagagacgagggaggagctcactgagggacccgaggaaagcaggcaaagctgagggctgcctagaggagtcatgagctccgcaatcagagaagtcctcgtgccttaggggcaactttgccccccagcctacattttctgaacccagacactggagtggttttgtggcatggaagtcccttcatgcctctcctctgctcaaatccttctgatatcaccatgcaagccagagaccttccagtggctaaattctcacgtggcctcactcccaaccactttgtccacattcctcctctgtggcccaccctgaggctcctgctgggtctgggatgtgtcaggggactttgtgccttctgttccctcagcctggaatactgctccaagcattccaccacttcactccactacttcctttaagtcttgatgtacccacctgccatcttctcaggaatgcctttcctggggagtctgtctgttttctctttcttccttccttccttccttccttccatcctccccacttctttcacactcctcactttctttctccctttctcaactttaattattcctcttaccactatcaaaacacactatgtattttacccctttatctcatttctttctcttttttttcatctagaatataagcttcatgaggggagagagttttgtctgtcttcacctttgaacccccagtacctggaactgtgcttggataaaatattggtagatggaacagatgaataccaagcgaaaatcttacctttaacctacagagcaacaggaagtcactgaaatcgctatagtcttagtaggagaggaatgtgaacaagctcagcttcgggaagttttttgttgtgggaattacacactatctgggagtagtaagaaattggccacagcgaggccagttagaaagctaccgaggttgaggagggctgcctgaagcggggtgcaggagggccaaattggggcagggggtggtccagaaaacctagagaaatctcccctggccagcagggcacctaggagaggaagccatgcaagatgccagagacttagagaacgtagatggggaaataccaaggggcaaggctgcagtgcaggagtggttccatggaacaagcagggactccgctgtcagaggatcagggcgagtcctgactctccccagcacagtgagcccctctgaacctcaggatcattatggatgagacaggagctagaagctcaacacatcaaccactgatagtgttttgggcactgtcctgggctctctgcctatgtcacacggttcagtcttcacagccacttggagtttgacatgaacctggttgacaaggtgagcacaagaacgtcccttcggtgaataacacctcttagactggggagtgattaagatgagtcagcggccactgtgcttttcttttgcccaataacttaagttgggggaaccatgcttcacagcatagtcagaaggactgtgaatattaaacagtgaactagtccattatctcagaagctgaaggtgccactaaaatgtgagtttccttgccattcaagatatacactctgatatctttgatctcagttgggtgtgtcattttctctcccaggagatctttggcaaatgtcttcatcctctgctctgctctgctttgtgaaacacagtcagaactcagtttttctctctggtcatcccgtggaaggcttcgcaggtggtacattcttggcgtggttgtgaaccccttggggtgtgtaacaggtgtgatgaggtcattttcactcggctttaggcgtgctgtaatgggaatgatgaatttcaacataaacctcatttttttcctcgctgaaaatagaaacttcttaatgaaaatatgttctgactgcttggagccagaaatgcaggttgaagagcttcatttcaaattttgaacagtatgaatggaagaaatgcaaaccatctaaagcgttcagtagacaaaagcatttcattgtgcttctctaacttctggttgcagttttactattttaagtgcaatttttagcatgcttttcaagagttttaatgagacatttcagtgggcactgtttacttcaaatcacttacatccaacttgaaaataagaattaagaaggtagttgagtttccaaccacaagaaatatacaaataccatgtgtattagtcactcatgtccaacgcnnnnnnnnnnnnnnnnnnnnnnnnnnnnnnnnnnnnnnnnnnnnnnnnnngctttgcaaccccatggactgtagcctctgtccatggaattgtccaggcaagaatactggagtcggttgccattcccttctccaggggatcttcccaacccaaggatcaaacccaggtctcctgtgttgcaggcagattctttattatctgaaccaacagggagctcatacaaatatcataggacatttagaaatgcaagtttgtgtgtaacagacatacagtccaagatgggcattcctaacaagaactttcaggtgagcaaatgaagtgccagccggggcttcagaacagcacgcgggtacatgctctgtacctctcataccatggggcacttctgctactggactctaggtggcttctctcctgggtcagggctcagggacactttgtgaccccgtgatttttgccagcatccagtctagccttcctacagtcagtgccactttgagcccctttccctgatctaggaatggaagcactcaagttccctaaatatgattcagatggaagtgaaagtgttggtcgttcagtcatgcgtgtccaactcttttctacctcatggactatatgcagcctgccaggctcctctgtccatggaattctccaggcaagaatcctggagtgggtcgtcattcctttctccaggggatcttccccacccagggatcaaacctgggtctcctgcattgcaggcagattctttctttactgtctgaaattcagatggagctcactatcaattcaaaggcaggtacagaatggcatgtgttaagaggctttagggacggcctaatgataaatctatcacttagcactgatttctttgagcaaagacagttaccatcttcaaatacctcacaagaactttttttttccatccatataatgaaaccatggacttcccccactccccacccccatagctcagagggtaaggaatttttccctgcaatgcaggagacactggagatgtgggttcaatcccagggtggggaagatcccttggaggagggcatggccacccactccagtattcttgcctgaaaaatcccattgacaaaggagcctggcggggctacaattcaaaaggctgcaaagggtcagacacccctgagcacgcatgccgtgaaaccacagttataaatttgagtgagttcagtgctgttgtctcagatgaacagaaacgttccaggtttgcccacacaattgagctggagcttcatgtcatgacttttaataggacggggaggctagtgagaaggagatggagaaatgaacctcttctttctcctctgatccccctgtagctcttgttcaccgaggcagactccaggagagagaggagaggaaggacaggcgcactgggagagtagagtgcacctgtgtcttctacctccttgtcccttttccccgttgcctccctccaccaacgcctcccatacccacgctgccaccaaagccttcatgtgcccccaggcccccctgcggcctctgcgctgaaaatgcagccagtccaagtgcacggcccctggaaccaagcgccacccaatgtggccctgtcctcttggtgtttgatgcatcccataaagaacctgcctgctaatgcaggagacacaggagacacagatttgatccctgggttaggaagatcccctggaggaagagatggcaacccactccagtattcttgcctggaaaatcccatggacagagaagcctggtgggctatagtccatggggtggcaaagagttggacacaactgagcagacacacacacacacacacacacacacacaattttacagcattcaaaacatttctagatcttttgcatttaaatctcctgggttgggagttacaggtaatttggcaaagcaaacaccataactagtctcttacataaccctacaactggcagcagggaaccacgcatggagattaagcaaccctcactcatccaggaagactttgcgtttccttttatggaggaataaatactcagcttgctctttcctgttgcatatattcttttcattattggctgactttaatgaatctttgaagttaatttttacatgtgaacaacaggattccacttaacttttggaagcttaagaggtgtccacgtgtgcctctagactagagaatgtttttcataaataacatgactgcgtttaggtgataatgaaattggagagagtgggaagaacctagcactcagaccgccatagggacctaaactgacaaagtacttggagttcaaagagttgcagcattttaatgggagtaagggcttccctggtggctcagcggtaaagaattggcctgtcaatgtaggagactcgggtttggtccctgggtcaggaagattcccctggagaaacaactggcaccccactccagtattcttccctgggaaatcccatggacagaagagcctggtgggctacagttcatgaggttgcaaagagttggacacaacttagtgagtaaacaacaataacatttaagagagacaagcaacaaggacctgctgtatagcacagcgaactatagtcaatatcctgtaataactgatatgagaaaagaacctgaagaggaatagatacacatacacgtataactgagtcactttgctatacacccgaaacttacacaacagtgtaaaccaactgtacttcaattaaaaaaataatagtaaaatgaaaacttgggggaagttgcagccttttcaaaaaactggtaccctgctattccagtgtgcttctagaccagacctcttacctgcaaaaaggccaactgaactagcttttcaattgtgctatccattctttctatttcttcatcctttcctatttaaaacaaaaccaaaaacagcctctgagtctccaagcagacagcctcttaatgttttctttctcagcttcagaggttcagattactctaaaatgttttcgtatcttttttccgaattcagtaggcgttaggaaatgatcaaagagctacctattcctagttgtccaattacaaagttttccaacgaaaatcctaggaccgcttcccacattctcactatgcaatactagtgagaattaggacattgatccaataaagtttcatcagaaaaaaaaagggggggtggggacggggcacatttcgtaacgaattctactttttttcttaaaaaaacagaggtcattgaccaagacagatttccaaatgttttctctaatatcccagtatatgaaactttgatttaagtgttcaggaaattacagggatcaaaccattccccaagatttcggtttccaggtttctccaagccttgaaagttccctgcaggctaattactatttactgctgtaccccttcctgcttctgtctgtaacattttccatcctaagaagggtcgtcccattcagcggcggagcctggtgactgagtggctgaatggaattactaccagtggaaactatgctgcaagagggagagataaaacagctgcaaagcaaacctcggccgttttttccatcctccccaagcgaagttaattagcatagggaaaatgactaaggtgtttacgtcacctctttccagtagaaacttacactctgtccctgtccgcctgcaagtcaagcagggcttgactcaggaatttggtgtccaaacaggatgccctggaagcagtgcttttttttaccccggggttggggcaggggcggggggagccagacctcattgctttataagcgccagctcgagaaagaacctgacagcttctggtaaaggaactccatccacttggggctcgactgcgggagtcgctgtagctctcactgtaagaaagcaagatgcactttagaaattttaactacagttttagctccctgattgcctgtgtggcaaacagtgagatcttcagcgaaagtgaaaccagggtaaggcttctgatataatgtaattttttttttttttttagagagttttcaaagcatgatgttatttggtactattagctgagatagttggtggggatgtgtggttctctgcgggtttggggggtttttgaaatgcatccagaatgctttgagccttcagaatcaaaaggtattgcctgaggaattacctctgaaagaattttttaaagctcagtatttaaaaatgtctctgtctcttggccaattagtaaggcagggttcagcatggtgtttgtttgtttgtttcattctgtatagattgtaagtaaacttttggagggaggacttttcttacagtgcacagaatgtttcactttgacatctcgagttcaggatactttgattgtatcttaggaaatcactattgtagagatatttgaatgtttgaagtaattataagggcctatcttcaactttgtaggtttttccaggtggagaaaatgcacccatagcaaataataaatagatagataagttaaatatcctacctcctggaaagcagctgtcatcaatggttattaatataactagtgattttaactaccatgctttacttcttcatttgattaaaatgccaagatttccatcagtagctatgaagctatctaactgatctctaaaacaagactgtatatgaatgaattctgtgtgttctctttagggggcagtgatcatgttatattcttatgcctaaagctatactgagtcttgggaagttttctttctttcttttttttaaatcaaatttaactccctaatcatgtagtctgcttacaagccagaatcgtagttttttaactagatattagagaatagtctatgtgtacgtgggtgcttgttaagttgcttcagtcttgtccaactctttgcaaccctatggactgtatgtagcctgccaggctcctctgtccatgggattctcccggcaacaatactggagtgggttgccatgccctcctccaggggaacttcccgacccagggatcaaaccaacgtctcttaagtctcctgcattggcagatgggttctttatcactagcacacctgggaagcccaatctatgtgtaaacgttctacaaaatctatgtatttaatattagccttatgtgagtaaaatcactttttactcatttcagtagagatgccacccaacaactggaataacaaataagattattttataaaagaacggtaggagagcaatacgaaattaacaaggtagtgtgggttctcttgcactctggtcctcagccctgacttgccgtctaaaaatatccatcaaagtcatatctcttaagttatgaatcataactcgaaacagttggtcacaatgcctacggatgaggtcgtgtgaaattccaaatccgcacagacaccctcacgccccggacttacccgtgctccgcagaggggcagagaccaaccaagtcactgcacggccagataaactcgaagctggaccatctgctgcgcattcgctgtccttctgtttctctgcgacacctctcgtgggaaagtcacaggcttttacatcaactaaagaaaagccaaggaactggaagagagaaactctgtgagctcttcccactcacctggtagagatgccagccaggagggaaggcaggccctgaccaaccatgcatccatccggaggaccatcccctcctccactccctagcaccaaaaagtctcagggacgttctcctcttctgctggaatcctctctccactttgcagaaacagcatgctctctatagatttccagggtccttccaggcctcctcatctcgccagtcacctgggtagaggacacgctgtctgccccagccccactctcagccaaccccatcggcctctcaccatccccagagtttagtctgcaaaaaagattcagaaatctggtaactgacagctcctgcacaatcttcctacaaatttcaagactgtccatcaacaccttcccctctggttggaaaagatggcagtggtctcccagttccccaaaaccacaccccattcaggacccaaccctgtggtggtggtggtgggggttgcttctgcagaacttttcccaggatctgatgaaacattctcctgaatctaggcttttaatcattgaactcaggcatttcagttctaagatctcatgctgcttcacaatgttcactagttcttaaacactcgagctaaatgcatacgtgtattaaagccagtgtatagaaacaggttctttgacagtacattcatttttaaaaaccagtattattttagagagttaaaaaatgacagactgagaaaatactactgggaattttttttttttaactgcttcctttatggtaagaaatgcaaggcctttttatacagagtgaagtaagtcagaaagagaaagacaaatatcatatattaacgcatatgtataaaatctagaaaaatagtactgacgatccgatttgcagggcagtaaaggagacacagacataaagaacagacttgtggacatagtgggggaagaagaggatgtgatgatttgagggaacagcattgaaacctatacattaccatatgtaaactagatagccagtgggaggttgatgtaaggcacagggagcccacagtcagtgctctgtgacaacctagaggggtgggatggggaggaaggtgggaggagcttcaagaaggaaggaacatatttacggccaattcatgttgatgtatggcaaaaaacatcgcatattgttaagtaattatcctctaatttaaaaaaaaaaaaaaacaacataaaaaaaggcaaacaaccataggtaaaatgtacctttaccacccatagggcagaaaaaaaaataagaaatgcaagccttttaaaattaactttattgtttcccaattcaattaaaaaaaatttttttttcaaactagctccagtgtttgaaagccctaagtaatatttgatggacagggcattgtcctaagcggagtggtgggactgaagttcgctggattggggaggatcatggaacaataagatctgaagttggaagttcttgaaacaatgaatgattcagtttctccataagaatagtaatgaagccatccagtcaaaggtcctgtgcaggtagattccaattcctttcattttttatttttcaggccaaatttgaatccctctttaggacttatgacaaagatatcacctttcagtattttaaaagcttcaaacgggtcagaataaacttcagcaaccccttatctgcagcagatgccagactccagctacataagactgaatttcttggaaaggaaatgaaattatattttgctcaggtgagtggatttcactgatacccacacttcccccttctccctctcacccttaaagtgaaagaaagtgaagtcgctcagttgtgtctgactctttgcaaccccgtggactttagcctaccaggttcctccatccatgggattttccagggaagaatactggagttggttgccatttccttctccagaagatcttcctgacccagggatcaaacccaagtctcccgcattgcaggcagacgctttaccatctgagccaccagctttcccataaaacagagtatatatccattgttgttgttaccgtcactaagttgtgtccgactcttttgtgaccccatggactgtagcccaccaggctcctctgtccatgggatttcccaggcaagaatcctggagtgggttgccatttctttttccagagaatcttcccggcccagggatcgaacttgggtgtgctgcatcttggctggattctttaccactgagccaccagggaggttcctagacacccattacctatatgttgattgagaatgccaagaaatcgtcttcagaggggcaaaattcatactataaatgtatcacatccccaattttgagatagcagggtatagttgatccctgacctcatagatgaccttcttgagtgatgatgggaaaaagagtcttttcctgactctggaaggtagaggaccacagggtggtagacgtgactttgctagaaccccagactagagaggttctggctttatgcaggttctgagcaggactcagtagcccacttacttctggagagcctgtatctgcaaacccgccctgcacatcaacatgggggctgccaggtccagtctgaaacaggggaaagaaatgggttcattaggcaggtagcaaaatggtaagaaatccttttaggaagaaatccttctggtaagcgggggtctgcgtgccagggcagtcccaggtggggtggggggctccagggcaggtttgcttttcctcctgcccatcacctccttcctgccccctcccctccttgatggtagaccacccatcttccaggcagctcataaatttccacttgacgatgttatagacgtcttaacagcttggcaagagggcaaaagcccttcagctcctgctccctggtgaaagagacccccttgggggccctgagttctcggggcagaccgtgtagaggggcttccggaccctgcggggaaggcgaacttgccggccctgcctgggtaaattggagccggatgccctgccccctggtggatccaagccttagacctcggatccttgggaacaaatgcccttctgcatttggtaccattccatataagtgattgcttagaccctcccacgaccttttctggtttattaaagacatgttcattgtgaaatttttaggcggggggtggaggaggggcgggatactaaagaacaaagaaaatacaaagtggccagatttgaatgtaagatgactcgaacagccctccattcactggcataacttttaagcccccagaaccaggatcttggttattgtcccttatcattattttttttcttaaaatatgtatcctggaagctgggcttcccaggtggtgctagtggtaaagaaactgcctaccaatgcagcagacagaagagatatgatttgatccctgggtcgggaagattccccgggaggtggacatggcaacccactccagtattcttgcctggagaatccccatggacacaggagtcaggctggctatagtccatggggtcgcaaagagtcatacacaactgatgcaccttagcaggcatgcacacatcctagaaggtacatttatttttcccttcctcccttttggcatctgattcagagccccaaagagggagggaagcctgagagcatggcaagaccccatccctgctttgtccccctgaaaactgatgttggtcctggaggtgttgcttagcctttggagcgtctgtgatatgatgcaatgcctccgtaacacgaggagcttcaggcaattggttctgagatcccttctgatctcggccacagtgctttattttttttccatctgtactaaaattacctgtatatattttctatcagtctcagttcagttcagtcactcagttgtgtgtccagctctttgcaaccccatggactgaagcacgcccggcctccctgtccatcacccactcccagagtttactcaaactcatgtccattgagtcggtgatgccatccaaccatctcatctgtcgttcccttctcccgccttcagtctttcccagcatcagggtcttttcccgtaagtccaggtcaagcatccttcctcatgccaggagggcgctctactcacgtttgcacgatgatctaagttccctctctccgccgcttgtaagccgtttggcggttcaccccggactgagcctgtggacgcggttgcgtccctgagcgctgtcttccgcaggcggtcgtgaggtgccctcacgctgcctcagtccttcccccttcgagaaacatctcctccctctctcttccagactttacacataggcagctcgcacctggcccctccgaatccagacaaacagttcctcatctctcctcccgcctcgccgccggtcggctggaaacaagtggaagacgctactcccgtcataaactatgaccttttatacgctatctccaagctagggccaggtaagccgtgccctcgggtaaggactgggggtggggggaggtgaggacacatgcagaggtttgcccagggcgtccatcagagcacccctctcaccccgtcaccagagggatgccagcgcgtgctgtgaattgtctgtttggctttctgcctctgcatcagggtcacccattgccggggagcgtgcacacccgcccatctctggcctcttcccttaggaagaggggcaagctggccctggggacccatcaccgtaatctctctgcatctcatcacgtgactccgtcccctcacccaccgagcacagcccatgaccccccctcagaggtcctgtcgctccaagcggggatgagctgttggactttggaaaggggaaaatgggcctttccccacttccgttaagttttttttagtcaagggaattttgttcaccaacctggtcctcacctgcccatttgaaggtgtgagcagtcagagacccagaggtcacaagaggagaaggagccccagacacacaggcccataggcaggtgctcacccgctgagcttgccagggagggagggggtcgcggggcggggggggggggcggggggcgggcggggtggagaagagattctgtgcctctgaagggacaaaggtgtgagcatttgggaagaaaggtactctggcctcaggcttctcatccagaaaatgggtattccctggtagagttgtgagcaatatacaagatcatcatgtaaaaagcacttcatacaatgcctggctcatcggcagagctcaatacctgttttctggaaacagtaaaatgttggtggttcccgtcctgtcgatagggtttgggtgagctggaaggtgcaggcaggggtcttggggtgaccaggtttgagccccacttctgccctatccatggggcaaatgcaataaacactgaggccatcagctttctccttgaccaataatctgactgatgttcctctgagtggagagttttgttttcctggaccatcagcagtttcatatgaaaaaggtgacactgctgttaacacctctcagacagaaaactcccgctatggtagaagcaaagatcacattacccactgctcaccgtggcattaagttcaagttggaagtgccagcgttcctcagagcagctccaggctaaggtgcattagcagagcccagggttggaaacttctggaatgttagagaggggaaaagggagacgtcctcctagagaaaggactcacactgtcccaggggcaggaagtgctgttaatgaacattctttacactctagaacctaccacttttttttacagacgtcttgtttgagaagcccttttagagaatagacatcaatttgctttcagtttacccaacaatgagcttgaatagtaattcatatttcagctgtgcttttcagccaacaagactgcaaagattttgcaaatgtgatcccgtccccttgctttctggattatgcctccttggcaggagataaagatttgtaaagaggatcatgaccaagattttgagtgatatatctgaccctctgctttaactttctgccccctgagaatattgaagctcgttcaccctttcagtactcagtcattcagtcacgttcaactctttgcaaccccatggactgtatgtagcccaccaggctcctctgtccatgggattctccaggcaacaatactagagtgggttgccatttcctcctccagggtgtcttcctgacccagggatcgaagccctctcttaggggtcttcctgacccagggatcgaagccctctcttatgtcttctgcattggcaggcagattccttaccactgggccatctgggaagccttcacccattcagtgaaatgaaagttgctcagtcgtgtctgactctttgtgaccccatggactaatacagtccgtggaattctccaggccagaatactggagtgggtagccatgcccttctccaggggatcttcctgacccagggattgaacccaggtctcctgccttgcaggagaattctttaccagctgagccacaaggaaagccctttcaggggcagttacaataacattccagtctcccgtgtgggcttgagaagaggcaacactttgtttatgagtaaaagccccttgactgagcctgataaatttcaggctgccgtacaacagcaggacactcctggtttgagggggttgataattgtgtgaaaaaggatgctgtgatcaaaaatgcttttggagcacctggctcagaactcacatctgtttcttttgggcaaagaggcttccccatgcttcccgtctctagcctgggctgtgaacttcagtgaaagccttcagtggggagagatgcccaagagggccttacctgatgcctttattcatacaacatcttttcctgaacaggtgccactttcaccgtaccagggaagtcccctgggtagtttagagacagtctagtgtacacgctaaaaaaagtgaaagtgttagttgctgggttgtgtccgactctttgtgaccccgtggactgtggcctgccaggctcctctatccatggaattctccaggcaagaatactggagtgggttaccattccttctctagaggattttcccaactcagggatcgaacctgggtttccagcactgcagggagattctctaccctctgagccaccagggaagcccatgcatgcaaagagtaattaaatacacattccttccatgcctttcatatgcctggactcagagtgtttgaaaacagagtcatttgcagtgttgagatgtgtaaagaaagtgaaattgaagtcgctcaggcgtgtccgactctttgagaccccatggactgtagcctaccaggctcctcagtccgtggaattttccagacaagagtactggagtggtttgccatttccttctccagcggatcttcctgactcagggactgaaccccggtctcctgcactgcaggcagatgctttacccctgagccaaggagccaccaaagaaataccaatccagagtgtgtctagctgtgtcctttggtccccagtggatgcacacagaagcttggtcgagctgactcctgcctgcacatccctttgctcttgcttttttttggcccttacctccttgcctgagttaccctgcaattattctctttctccaggggaaaagtatgaactgcacgcagccaccgacaccacccccagcgtggtggtccatgtctgtgagagcgatcaggagaacgaggaagaagacgagatggaaagaatgaagagaccgaagcccaaaattatccagaccaggaggccagagtacacacccatccacttaagctgaaccggcgcccggacaaagacgtgctccaaaccatgctcgcaagaaggcatcttttactgtggaagcagccggtcacagctttggaggcggcagccgtgaccgctgtggcggaaattccagttcacgttgctcagaagagaatcgaggcttcgtcccctggttctaacgctgcgcctcagtcagtgttcgtggctcctggccatgccccgagccaatcactgagtctggggtgatcgcacaaggacatctgggagcatcgagagaaaaccaataacgatagtattttgtacttgttctcttctggtaggttctgtcttggccaggggcagattgatccgtgggccccggggagagtctttgtgtctgatcagtctacaaggtagactcactctctctcctggtgggaaaaggcaccatgcgaagccacaaggcatctggtgcagaaaggttgtgagagcaacactgcaacgtggaaactgtagcgtttcattttcccccttcatgttctgatgtttgtgcatgtatattactgatttctcagaactaaccttcgttcctatgtagagttgcgccattgctgttttacatctttcggggagataagaaggcatctgcgaagtctgtcacctttccagattcatgactgtctttggaagggcacccacgacagggtggaggggattctacacggaatacacacaccattccacatcctgtccgatgcaaccaacaacttgtgcttttgcaaaagaagtcgatctgaaattcctgtgtagcatttcgcttataaaattcagaaaatagcactttcactgccaacttatagtgggtgagaaattttagtttagatgttttagatcagacaatacgtgggtttcatttctttctttgacgtggtagtttatataacatgaatcatagccaaaacccttttcggggggaatagtcagttgagatcattaatttttttacccccactaaaaaatcaagataaacttgtaaataaagctgatagtatatattcacacctgttgtgcacttgggtgagacatatatggccatggaagactagtgtcagatgtgttaacctccccgtgaattgtatgttgtagaaaacgcctttcagatgtttgatgggacttgacttcaaagcacgtgaagtggatagtgggtataagaagggtgcagtgcctttcccattaattcctggtggagtcgtcacactaggttaacgtttgtaatttttttctagtgtcctgtgtatgtctggtcgatgggtactcccttttggccttacgatactgtaacagtgtttgtccttttgaaatacctaatgccaagtgacagtgcatgctttggaaaaggggaagagggctttctttaagaagcaaaggcatttggctgtttctgtcaagaaactgactgaacggtctccaaaccctgtttacaggacctggtgaggcgtgggggacaaatgagcaagagacgcttgcatagccgttcaagtgttcctagttcagtgcttttaaactggagaggctaacctcaagatattttttttaactgcattctctaataaatcgacacaatatgctctttatggaaaagctttccgttgttttatttctaagggtcagcctgtgagccctttgacttctgcagtctcagaaggatgcagtcctttatcagtctgggtttgaaaactcccagttccttgccacggttcactggctgccggccacactaatggggcatcacgtagcagagaggaaaatggataaaactgaaatcagaagtctggagtgtttcctttgtccagggagaggatgctgagatgaacatcccttttgctatcagctcggctaaacaatggcttcccgggtgggggagtggtaaagaacccacctgccaatgcaggaggcacaggagacacaggcgggttccatccctgggtcaggaagattcccctggagtaggaaatagcaactcattccagtattcttgcctggaagattccacgaccagaggagtctggcagtctataatccacatggtggcaaagagtcggacatgactgagtacatgcccacacacacatacacacacccctctaaacaatgtttctgattgttaatttgaggaattttctttcctgtagaaaatatgcctgtggaacatactaagttgcaaaggccagttatgttcagaaagtctatctgtaagcctcctatttgaatttcatctggaagtctgatcaaaaatggtggtgtgctcctggccagccctcaaaggtctaaataatgtcgtgtttatttgcaaatgatatatatatgtgtgtacacatacatatatatatcttttgggctcagacggtaaaagaatccatcaacaatgcgagagacctgggtttgatccctgggttgggaagatcccctggagaaggaagtggctacccactccagtattctgccctggagaattccatggacagaggagcctggcgggctacagtccatggggtcgcaaagagtcggacacgacagagtgaattccactttcacactcttatttgcgaatgatatctgcttctttttcaagatgaacatcaggcatttttccatagaaattcacgtgctcctctgttttccattgaagagcagcctcattctgtcattcctcaagagcacgtgcatattttaaatttatgtatgttagaggtctaagcgtgtaggaaaatcctcatttgcatcaagttggttgaatctgactgttgagaagattcactaattaaccaccagggaaggagggtgaggctgtttattgtcatcttgttgaataactaggagccactgcagagcagaactggattgggaagtgtgctggtccagagtcctgtttcataaataaccctggaataaagtcgaattgtgttgtcagttaactcagatttccagtgggtccccttacatataactggagaaatatgggtggctggtcccattgcccgggaagccttcagatcctagagtagaaatccacacatcaacaaagagcctcacttctgatggacgatgtctgatgaatggttctgagttcaggtaactgtggtggcctcagctcaaatcccaaagctaagagtgctcacagtctagtctccaggcagatggctatgttgttattgttcagtcgctaagttgtgtccaactctttgcgaccccatgaactgcagcacgccaggctcctctgtcctccactgtctcccggagtttgttcacactcatgtccattgagttggtgatgccatccaaccgtctcatcctgtgccaccccgttctcctcctgccctcaatctttcccagcatcacgatcttttccaatgaatggactctttgcatcaggtagccaaagtattggagcttcagcttcagcatcagtccttccaaggaatattcaggactgatttcctttaggatggatgggtttgatctccatgcagtccaagggactctcaagagtcttctccagcaccacagttcaaaagcatcagttcttcagcaaaggcccctaaatcatgaacgtgcccaggactcaagcatctctgtagccctcctagtgagtgggctcagtaaaaggcaaaaggacagacaccaaacaggcagagtcgtgcagagcgcatcctttgccattgattggatgtgttccttaaatagattttgatagaatatatttctcatctgatggtaagtagcttagagccatccatcccagaaaagaaaatcagcatactcaaaatgtgtgctaaatccaaacaaagggtggtaaatgatgagagaagtataacatttcatgcagctattaatactcaggctaaaaacattgatttgcagttagcgagcattttaggatttgtcatttccagaatattgtgagatttagtgcccagaggaggtttgcatttttgcagagctttaattttacgtgaaattgtacagacctcatcactaactaaatacatcttctcaaatgttgcaaaggatcaaatacactctatggccatgttatgaccaaaattgaatcagcagctggggtatgtcctattttatagcatttaaagaatcctgtggaatatttgctccaagtgcctatcaaataaagttcatctaaaggtcaataattcagatggaaactacataaataatttacattaaaatgatttgagcagttagaatacaaataagaaatacatttttttttctttcccagttctcctgtcttctgattctaaagtaggacacagggaatttcaaatatgccagtgcttttggcaatcttaattcacatctgaaattctcacttttgtgactcaccaaacgttacatggccatcaggtagatggattttattctcacatacctcattttcttcagcactccctccccactgttcgtgaaaggtcattttaatcatgactatgcttgtgaaagacagagaagattatttgcaagtgattgagatgaggcgcctacagtcctcgtctctgtttaaagattctgattagagattagattccgttctacacagcaactgagagcccagtgattgctataccccctgctcaaagttgtacttcctgattgactttcatgctctggtcatgtggaatttgcagtgtttctaacttgctctgtccttcctctcttccctgtgctcctctgagtgtgtctcctaaaacatcactccacggcccagccccacctgggctaaccccacagtgatgtgaatcccatgagactggtcccatgtcttccccactcacctgtgtctgagtctctcgcagctaccaccaggcccagcctgcagggctcaataaataggcctgaaataattaaccaactcaaccgtccttgccctcctctccattattaatgtctccctctctccgagaatcattcccagccactcctgctatgtcacccattgtgccccatacttccaatgtatggccttctcagcatagttgttaaattgtctggcttccctgttagaacagaaattaagtggaggtgggattcctggtgacccatggctcatggtagacattcaacaaaaagttggatggatggatagctgggtgtgtaggggagggatcaatggataggtggctggtggggggtgggatggatggatggatggagatttcagaggatgtgtgagaggtcactgagaacaaaatagaaaaataataaggcatattcccctctgcctagtcagtagagccaataagcagatccctgtttgaatccaacaaactggcagactgctagagcagcaataatcaaaaggaaagaaaaggagacacaagtgtgttggggtagatccatagatgagaaaagaaaaaaaattgtttttaaaatttcttttcaaaatagggtgagtgactgaatcatgaaagaacttttcaggacaatgaaaaggatctctatctggatggagcagtgcagcaacagaagcagtaacaacagcccagtagttgtaaagcaagtacatgcatttgtccaaaactcatcaagaactgcagacttaaaatgggtgtgtttcgttttatgtaaagcatgtctcaaagttaatttacttttttaaaatttttaaatcttaagacaaaatcttaaggaaaaaatttttaaatcttaagacaaaggacaaaagttaggggaaggccttaatgttcaccatatctttgtcatttttcacgtgtgtaatgctttggtaacatactcagggcttccctggtggctcagtggtaaagaatccgcctgccaatgcaagagacatgggtttgatccctgggtcaggaggatcccctggagaaggaaatggcaaccctctccagtattcttgcctaggaaatcccaaggagagaggatactggaggattacactccatgaggtcacaaagttggacacaacttagcaactaaacaacaacagcaacattcttaaacacagaacaaggcaaagcagcttcccaaattagagtatgtgcattctgattaagctttcctagaagaacttgatatgtccacgacaatctgttaactttaaaaatcaacttgggtcatatttcttaaagtttaataaatgactaatttttcacctgttcagaaccaaccaattgcttcttcaagaatataagcatccacaagtaaccagtggtatacgaaattcattttagcaggtctctaattcatgtatggatgtgagagttggactgtgaagaaagctgagtgccgaagaattgatgcttttgaactgtggtgttggagaaaactcttgagagtcccttagactgcaaggagatccaaccagtccattctaaaggagatcagtcctgggtgttcattggaaggactgatgctaaagctgaaactccaatactttggccacttcatgagaagagttgactcactggaaaagaccctgatgctgggagggattaggggcaggaggagaaggggacgacagaggatgagatggctggatggcatcattgactcgatggacatgagtttgaatgaactctggagttggtgatggacagggaggcctggcgtcctgcattcatggggtcgcaaagagttggacacgactgagcgactgaactgaactgaactgaatgtcagtgtacagtctcatcaggcctcaggtaggagtgacatactggaccaggaaaatacttccacaatgatgcatctgaaaataatgagctattagaaaaagaagcaaagtagcaacaacaaaaacgaaacccagtatgtttctgcaaggtcaactttctttctgaagcttctaaaacatttttcctgcaaattatacaaaatatgcgtcattcttcttcttataaaaacagttaagcaccacgagacttccttggtggtccagtggctaagactctgcacttcctatgcctgggttcgatccctgatcagggtattagaccccacaagctgcaactaagagtttgcatgcagtcaaatgcacaaaaataaatactacaaaacaaagaaaaaaatacttggtgaacttgagaagcccatttgtcattaacaaaattttaagcactgtgagtattagagaaataactttaaaaagctatagaagatcctcaacaaccattacaagtagtggcttttgtcatattatgcagttttattataggataagttgccaaacaactcctcttaactgtgttaacttgaaggtgtgcttcaactaatgaggcaaattagtccaaatgccaaaacacttctcttaactgtgttaacttgaaagtgtgcttcaactaatgaggcaaaattagtcccagcttcagttttttgtctttctagcagctctttggtggcagaggtactaacaagtaggtgcatacgtgctgtctgtagcagaaagcccacacgcctacgtgcagctaagttgcttcagtcgtgttcaactctttgttaccccatggactgtagcccaccaggctcctttgtccatggggattctccaggcaagaatactggagtgggttgccatgccctcctccaggggatcttcccaacccaggaatctaaccagtgtctcttatgtctcctgcattggcaggcaggttcttcagcactggggccatttgggaaacccagcagaatacatacagtcctgccaaatccaggagatagatagagaggaagcaaaagtcgctcagtcgtctccaactctttgcgaccccacggactatacagtccatggaattctccaggccaaaatactggagtgggtagccattcccttctccaggggatcttcccaacccaggaatcaaacccagatatccagcatttcaggcagattctttaccagctgagccaccagggaaaccaaagactactggagtgggtagcccatcccttctccagaggatctttccgacccaggaatcgaaccgggtctcctgcattgcaggctgattccttgccagctgagccaccagggacagacaggaaaggggtcttaaaagccaccccaagatgtggtgtattttcatttggatctgactgcccatctactgtctccctaactctaactgggcagcatctagaccctaagtggcttcagcttccagtcagttacttcaagttctctctgctgaatttcataaatgatttgcctttcagttttgttgagacctgattctagattcttgatggatttaaccctcatactgtttgtggcctcaccaaagcggatgtcacatgttccccgaagttatgcaatataacttcactgagtctagtgtcataacctattgagaagttatcctttgcatggatgttttttcctcgtttttttaaacccctgtaggcttattaggaaaactatgggaagaatttccccttccaaagtgttgaaccaggataatgtgctcctaaccctgggctccatgagcccctagatgatgtcaacaggatctcctggggtcctggggtctggagatcccgtctctgaaagattaagggcttcctggtggtcaagcttccagtgtctgagaaaagagccagagtgaagagtctgtgctcagagctgggagggggcacaactggttggagttggggtgggagaaacagaaggggctacaaaaggagagagctgacactggaagagcttggctcatcctggtgagggttttagctccaagtgtgaagctaaacttggcaagactgggagtcaatgacggctcccactttaggagcctcttctttacctgggctgtgcacgcccaggagcaagggcaggggtagcccctgcagagaaaggactagagtctcccatggcacagcgggcaggggtagggatggggtaggtgtaggcagagccccaggtttcctgttcacccaaagagcccccagcactgacctccactgatgtgccagccaacctctgaaggcaacgtcctgagtgagtttccttttaccctgttcttggggtgtctggggttttttccattattttcagtcattcagttgtgtccgactctttgcaaccccatggactgcagcatgccaggtttccctgtccatcaccaactcccagagtttactcaaactcatgtccattgagttggtgatgccatccaaaaatgtgccccaatccagagtttcactttattttttttcctcttaatttccacacagaacccttagacctgtccctcctcccgtgttccttatctcccgggcccagagcacaacccgctctctgcgcagagagccgggaggtggcactcagcgagatgcggtgggcttgggtggctgacacccccgacttctggagctgccctccagccaaggccagcagcgccccctgctgcccgtgttgagctgtacacactccgggagtagggagcagagagaccacaaccagtgcggacaggaaatgatgaggtctgacgaggagaagagcggaggcagagaaggaacccaggcaggcagggtgcccagcgagaggccacccctgctctgacatctgcattgtccccagtcgtgaagagagttcccagagcttagcagaagttggcttaaaacgcagcattcagaaaactaagatcatggcatccggtcccatcacttcatggcaaatagatggggaaacagtggaaacagcgagagactttattctgaggggctccaaaatcactgcagatggtgactgcagccatgaaattaaaagacacttgctccttggaagaaaagttatgaccaacctagacagcatattaaaaagcagagacattactttgccaacaaaggtccatctaggaccttcaaggctgtggcttttccagtggtcatgtatggatatgagagttggactataaggaaagctgagcgccgaagaattgatgcttttgaactgtggtgttggtgaagactcttgagagtcccttggactgcaaggagatccaaccagtccgtcctaaaggaaataagtcctgaatattcattggaaggactgatgctcaagctgaaactccaatactttggccacatgatgcaaagaacctactcatatgaaaagaccctgatgctgggaaagactgaaggcgggaggagaagggaacgacagaagatgagatggttggatggcatcaccgactcaatggacatgggtttgggtggactctgggggttggtgatggacagggaggcctggtgtgctgcagtccatggagtcgcaaagagtcggacacaactaagcgactgaactgaactgacaaggaggagaggaggggaggagagaaggaacccgggcaggcaggtggcctcatcagagaggccacccctgctctgatgagacattgcattgtcccagtcatgaagagagttcctggagcttagcagaagtccggcagagactgtgcctcctgggtttagaaagaatggaatcggtgagaatgcagctatgaatctgggtggaggggttgtggttggcagactggccaaaccggcccgcaagagtccaagcccatcccccacccccaccccaggggaacaaccctctccccatgagttgcagggatgcagttggcaagacctgtgacattacaaatgtcttccaattggtgaatatccacaattaaaattatgtgcccatgaattagtatcagtacttgacaatatctatctatgtgaaagggcatttttaaagatgaaattggtaaaatctcagtacaaatcagcattaacagatgaacatttgcaactgatttttattgtagggtatactaactttgaattccacttaagtgaaatgttatccctccttcaaaaggagagaattccattggcagacctctattacaaaaaatatactcagtagtttctgaattttgtaaaaagtgtgtaaatttgttttttccttttgttatattactgcctccacaacgttcttatttttgcctgtgcatttacagggcccaaaatatttactatgatggccatcacccccatgatgataatcacttgttatggcaaaagggatttcgcagctagaactcagtacccaactcagttgactttgagttaatccaaaggaagattctcctcccaggtgggcctggcctaatcgggcgagtcctgaaaggcatcgagagcctcagctgggctcttctactggccaggaagatgcaaggtgtgagaggagggccatgtgccaggcacctggggacagcttctagaagctgagagcagtccctgaccaacaacagccagctggaaaggggatgtcagttctacagctgcgaggagatgacttctgccaacaactgcatgagtttggaggaggactcttgagcctcaggtgagacggcagccgtggctaacaccttcacgccaagggggtctcacctggggagaggccctgagcagaggtcccagctgtcacaggcctggatcctgatccactgaaaccataaggtgatgaatgtgttgtctaaaacgtccatgctggtagcaatgcattgtgcagtgatagaaggctaatacagaggtgtaggatgtaacctcagagatgaggtgtgatgtctccatttggctagatgcacagcgccacacggcatgttcaaggccggcatctctgggggagacctgtgagctggcagcctctatggacctgaactctccccagaccatcccctcactgaatgcagcagcccatgttgacttcagcactgacttcttgtctcctttataatgatgcatttgtaaatatattgtaatagttacattaagcacttttctaagcaattttgcaaaaaaaatgttttccccaagaatacaatattctcagtacaaagcattgttataaactgtgccaaataatgctactatgatcttaagaatcaagcttcccatgattatcagaaccagtggaagggtaaaagcccagagaaggccacacacaggccgttgcactattatcatgtttcactcaaggctcattcagcagggatttatccagcacccagatattccaggcgctggagatgaggtgatagagaccaaacacagagcccactctcacagaacttggtaagaggaactagacaataaatgtataaataaattaattaaataacttcagataggagagatgcctggaagataaacatgatatttttgttctctatggcagctggtaacaaattaccacgaatgcagtctggtggctcattggtaaagaatccacctgcaatgcaggagatggcaggcttgatccctggtttgggaatatctcctggagaaggaaatgacaacccactccagtattcttgcctgaaaaatcccatggatagaggagcttggaggtgttcagtccaaaggattgcaaagagtaggacatgactgagtaactgagcatgtagtcccttgacaccacaccaacttattatcttacagctctagagatcagatttctaaaatcaaggtgtcccaggtctacattgtttctggaagttcaagaggagaatcctcgccttcttcagcttccagaggccaacagcattcattggctcatgaccccttctttgtgtcactctcagttcagttcaggcactcagtcgtgtctgactccttgcaaccccaaggactgcagcacgccaggcttccctgtccatcaccaactcctggagcttactcaaactcatgtccatagagttggtggtgccatccaaccatgtcaccctctgtcatccccttctcctcccgccttcaatcttttccagcatcagggtcttttcaaatgagtcagttcttcgcatcaggtggccaaaggattggccaaaggctttagcatcagctttagcatcagcccttccaaagaatataaaggactgatttcctttaggatagactggttggatctccttgaagtccaagggactctcaagagtcttcaccaacaccacagttcaaaagcatcaattctttagcactcagctttctttattgtccaactctcacatccatacatgactcctggaaaaaccatagctttaactagacagacctttgtcagcaaagtaatgtctctgctttttaacatgctatctaggttggtcataacttttcttccaaggagcaagcatcttttaatttcatggctatagtcactatctgtagtgattttggagcccaagaaaataaatctgtcactgtttccattgtttctttttctatttgccatgaagtgatgggaccagatgccatgatcttcgttttctgaatgttgagttttaagccaactttttcactctcctctttcactttcatcaagaggctctttagttctttgctttctgccataaggttggtgtcatctacgtatctgaggttatcgacatttctcccagaaatcttgattccagcttgtgctcattcagtgcttcatttcccatgatgtactctgcatataagttaaataagcagtgtgacaatatgtagtgacaataatatgtgttactctagccctttgcttttatcatctgttttaaccaccattcatgaacgagagattcctgccccagggttatggcaatggataaacacaccacacccaacataggacagatgagatgaaaagaggtttatcaatcacaaaaattcacagcccaggcttccctggtggctcagatggtcaagaatctgcctgcaatgcaggagacccaggatcaatccctgggttgggaagatctccgggcagagggcatggcaacccactccagtattcttgcctggagaatccctaggacagaagagccgggaggctatagtccatagggtcgaaaagagttgaacatgactgagtgactgacacacactacactcacggcccaggagaggggatcactgcttactaggcaagatcacgtggggatcacacagaacagggtgaaaaagctgggctgtgggatgcaggctctgtagtgacacgagagtgcagtggcccctggttcccatgggaagatgtaatggccttgtttggtacttctaccagccaggagggcaatgaagcccactgctcagggggtaagcagaaactgagccctgtctgtttgatgagggactggtgtttagttgggggactttagccacaggagcagagtggggaggggaatttgcatttgggtcataagagggcttctagtttcatcagatggcaagatcacataatcgcgagtctcattttatgtcttacaccacatggtcacatctggtactctcagcaagaagtggtcaagtcaagatttcaacccatattaacctgcctccagagctgcagttctaaccatctcactgcacttccctcctccacagtgagccacggcagctggtgtgcaaagccggcccccaaggagccacagctgccagcatccgtgtcctggcgatgtcctctcccacactgagtctgcactggcccccaagacttggtttaaccaacagaacatggggggagtgaccctctgcccattctgaccctcagaaggcctggcagcctctgtttctgcccccttggcagccagctgttgggtaagagacagcaagtaccaagagaggagctggcaggcacagagcctcggggcaggggagacccctaggacaaatgcgagccacctggctacactcgggcacaacggggctccacacagtggaacgctacatgcaatgcaggctgaaggtggtgcagaggcaggagtgccagctgtgggcagggagggaggtgaggatgggcgtgttatgtactgtgctctaagattctttgggagtctttgaaagatcactgcaggtccttatgaaaacaagtttcttattccatcattcttgtttttttttttttttctttttaatttttacccattttaaacaattatttatttatttggccacgctgggtcttagttgcagcatgcgagatctccagtcttcattgaggcatgtgggatctagtttcctgataagggattgaacctgggccccctgcactgggagtgcagagtcttagccactggaccaccagggaagtcccttattccatcagtcttgaaagaccctttacaccgtttcataagggttggctgtgatgaactggaacagacagcaggccagcagcatgccaatccgctgaaggaatgtgattccaaaagtcacttcagcgatgattcccatcttggtctacaggaaactggtcacccaatcataacaaccgtctggttcacgttagtggcagccatggtgaggttgtgtagatgctggggattataatcaattttgttcatacagcagttcatagggctcccctggtggctcagacagtaaagaatctgcctgcagtgtagaagaaccgggttcgagctctgggtcaggaagatcccctggagaaggaaatggaaacccactccagtgttcttacctggagaatctcatggatagagaagcctggcaggccacagtccttgggttcacaaagagtcagacacgactgagcaactaacagttactttttacttgttcatgcagcaactcaaggcgatgccatggtccaggaagtggaggctggagcttcggtttgtgtagttctgcacggccacagcatctcagctgttaacagggaaaggaaaagaattaagtgcagcagatcaaaggctttgtggtcctgcattcctttttcttggactctaaatggaggcaggtcccgcaaacacaattgagaaagccatgttggggggtagaacctaatgaatatgaacatttcacacaggtgttttctcaatgcagcctgtgtgccaacatggaaacacaggcctggctttccccagctgtatccaagagaggccagttcccatctcctcaccccgtggctgtgttcatattattatctgcccgatcgatccaaccagcagagttaagctagagcaagaaatcactgagtgatgagaaaacatgattagtctagacgctcagcagttttctgaaaggttttccccttgggatctatagagccaaccatgaagagttgggacggaagggatgtccctgcatctttgatcctgacctacaatatggaaccactgttcagttgattggtcacatccaattctgtgaccctatggactgcagcatgccaggctcccctgtccttcaccgtctcccagagtttgcccaaattcatgtccattgagttggtgaaccattgcaaccatataattctgaacctaaaatagtgattcattcctgaggaattctctgtagcacctgaaaacaaaataatctccaagcataaggcatcttacatacaatcattctacaattcaactgacaaagagtatatgttgaaatgacttctaaacaatgttccattaaaaaattacttccattaaaaactttttttctttcccctagaaacttctgtcttgtctcatgaagctcaagaaacgggaatttctaccaacttggaggtggaaactgggtgtggaaatgactaggagacaccccaagccggggcctttgcaggggtgtagtctggcctcttttaagctggagtaaccagtgcgagtgtttgcatgcactggactttttatcagaacagaggggagatgaagaatctgtatggtgatgctgagtagtactcaggacacatcagcaaaatgagtacaaggaaaccagtccactcccagctcctaggagttgcggtgtagattagaggacaggtttgcatcctcacatgtcaactggtcctgcttgaatctctaagaccccggagaggtcaactccccgctccataacttaggaaaccctgagccttacatgatgcctgcggcttccagtcttactctctccacatccacctctgcctctctttggatccacacctcctaggtcacaaagtgtgcctcagtcatcagctgcccaaagaaaccaaaagggcggaaagaaggtctttgattttgttttgcttgtttgttttaaatgtgtttgctatcagtcactcagtcgcgtctgacttttgtgacgtcatggacggtcgcccaccaagctcctctgtccatgggatttcccaggcaagaatcctggagtgggttgacatttcctcctccagatcttcgtggctcaggaatcgaacccacatctcctgcattggcaggcggattctttaccacctgagacatttttctaccacctgagacacagggaagcccttttatgagatatacagatgtacaattcacccatttaatgggtacagttcggtggctcttggcatatcaccacagtcaattttagagcattttcatcacttcaaaaagaaatcccaagccctttaatatcacctcccttatctcatccttcccctgccctgccccctgcccagcccaagcaagcagggatctactttctgtttgtacagatttccctatgcaggagcttcacagggacagaatcatatatgtggtcctttctgaccagcttctttcacacagtgtaatatttatgagtctcccacgttgtaatacgtatcagcactctgttcctttttatggccaacgactatttcattgtgtgcatatatagcattctgtgcatccgttcattggctaatggacatttgggctattttcctgctcttatgaatagtgttgctgctactgaaagagtctgtgtgtgggggtcctgctgctcgctactcaaaagcccataaacaggccaggttggtgaaaggaaaagtttgctttatttccagtgccagcaactggggtcaggagacagtggcggacatctgttcaaaggcccactcccccatcgtgagaagcaggaagcgagagctcttatagacagagggggcagggggctacatgcagaaacacacagtcgtctctagcagtcacctttaaataggtcaccagtggtctcaccagcatcagctcgtttcaggtacagctaatcttcagttccagggtgcacttgtccccatttctttacgatgcgatcagttctcggaatcgcggcagctcgtctcctgggtaccgtctggtcatgtagttagcttccccacctggtgttttggtgtctgtaagacagctcccaggatgtggcacagaatattatctacagcccttgagagggaactaaaggtccttgactgcgcttaatgactacattgttatcatttagtttcctttgactgcttccgttgtttccatgtttctcacttctctgattaaacttactccttgactaaggttttccacaggcaaaaggcaggcaaaggatgtggttgggggagaggggcaaggaccatatggtcctgctctgtttcattgctgtgaacatggtagcagttttacacagacaaagtgaaaacgtgcagtaaaacgttcagttttacgtggacaaagtttttatttttcttggaaagatgccaagcgtagaatggccaggtcatatggtcactccatgtttaatcattgaagagctgcctttctgtgttccagagcagctgaaccattctacacacccaccaggagcatgtgaacgttccagagtctgcaagtccttgccaaaaagcattgtttattgttacctaactctttccttctggtcatcctggcaggtacgaagtggcatctcatcgtggcatgtttgcctgtccctgatggccagtggtgctgagcatcttctcctgtacttaattggccatacattttgactcgagaggaggtgggagggcctcatcttccacctcactctccctgcccccttcctcaccctgtatcctcctgaatcccactcaccctaaatgctcacctaggtccagactacatggagtgacatcctcttcctctgaaagcccctttccagtcaacacaagggccaggactcagagcctgccacagtgggctctcctgacaaagggaggactcctaacatccgtggcttagatgaacatccctccattttcttgtatctgtgtaactagactatgggagggagatcactaggagataactcttagtattgacatgggctcaaatgtgtgcatgtataaagttggaatgtgactagttcacaaggataggagctattccaaaatgtcagaaggaagaaaagagtttggtggcatatgttgaaatgttagaccctcaaagaatttgcttttcctaagtatgtacttcccttagagtaaagcaggtggtttttctaaagaaggagattttggaagacaagaactcacccctgcctgatggtggccatggtgagatttgtgtggaaagctcagaaattctagagccgcacctcttaagagaaacagccgtggcttaataaggagtattgtggcctctgatcacgtgctcatctgacgagctttggctccgtcccagccttggacctgtgccctgaacgactcagcatttcacctgtcttggtagcaaaaagttgacagcatgtcctcaatgcactcttgttgactgaaggagagacagagttgtcgggtggggtcaggtgacttgagtgcagggggtgggatggggtggggcatgggctttccttctcttcgaataatatgagctccatccaggaagcactagggtttattcaataataaactcctatttaacaataggagtaaccaccaacaaaaactccatggtatgtttataccagtgtgaaggatagggcatgaaatgaaatggaataatgaaatgaaatgatatttcaccctgaaatgaaaaagtcaatctgagttttggtgtttattcctggttggtgcaaagagatgagaaactaacaagctgggtgacttgctcaaatgggcaaaccacccttaggccagtttcttcacctgttgaattcattcagtcattcatctctgaagctattgacacctgcttggtgcctgatacggggcaaaatgatggagctagagcgatgaatctaaatccttactatctagccaggaggaaaccaaccaggacactgtggggctcttctgagtgcaaaagcttttctgtgtcccccatttcttctctgtaggaaaatggtttcagcctcctagacctcccctgagtcccaaaggccagactgaaacggttactggttagaggaatgaggtaaggcagaaacaaaagaaaggcaatcaagaaacaacagggcagggtcctgatgctcagcagggctccacaaacctttccatgccccccatttctttgatcataggaaacagccttcactgagcctctgtgacctgccctgagttccagtgggcagactcaagcagttgttaattagggaagggaggggatgagagaccaggaagaaacagctaagagcagccttggggcaaggttctgtttccatcagtggatacacacaacaatgtctttgagctgttttgtggtatgctgcccatgaggatgtagaccgtagaccagttggacctgaaggttgcctacttacctcactgccaactcccagaagaacgtccacgagctgatcacaccctcttttaacaattactataaaacttctcactctcttccccaagttgagacacatggttttaaggtcaatagctcactgtgaccccctttgcctagcaaagtaacaaggttgtccttttccacttcacccaaaatctgtctttgagattcactttggcagcggtgtacagagaggctgagttttcagtatcagccctagttcctcctgaaagatatacttaatgatatatctctgagttgttctacaggaaccaaggcccccacataggaagaggactccaaacgggttgggatcagaacgctgaacatcaccctattacttcaccacccaccaatcagaggaaggtcacataccctgcagctcaccacccccacccaaattttgcctattaaaactcttcccccaggacttccccagcagtccagtggtcaagactccatgcttccagtgtagggggcatggtttccattcctgatcagaggacaaggatccacatgctgcatggcatggccaagaaaaaggaaaaaaaaaaagtcttttcctccaaaattgttggggactttgggcttttcaagcatgatctgtctattcttgctcgacctagcaataagcctttctctgcctcaaactcctacgttttggtttgtttggcctccctgtccatcagacacacaaacctgggttcatcagcaaggactgaatgcaagaggaagggttggtccatttgacctgagaggacccaggaaagattcctgcagcggcttgatgctaatggtgacacttggcacataggaaggactgccatatggatcaaaaaaaggaaaggtattttagatggttggcacaacagcgaactcatagcagtggagtgtttaatcctgtctgttcccagttcccaggacatcaacattcacacccttactgaggtatgcgacttccaggtctacacccgtaattggtgataaccccaagtcaaagcccaccttgggatccagtgcaccccaaggcttacagaggttctgggttactgttgagctcactgtctctggagttcagagtgcagctgaaatgtaccttgaccagagagtaacgggtgctggccgtcattagcttgtacaaatcacggacactccaagtgctgggaatgagctcatcattcaggggtgggtcctcctatctgggcttgttcctggggcactggcatggggcctatgaacccatagctttcttctgtgtacctacctttacacttcaggctctaatgactctttaatactcccatgttctcaccgaccacacctcttggaccaaaagactgtctaacccttctcattcacctccacccagacctgtgggtcctgaaacctattttgtagggcctgaaacctgcaaggtctcatgacctcatctctctcaaacggttgagtatctacctccaggacaataacaagagtggagtcctgggcacgtccttccagaccaacaaatgcttgtccccacttccatcctaggaaccctgtctccattcccagaagagccatgagcagcagtcattagggtctaccttgatggtagtcgctcatatcttctgtttggagcaggcaacttctgtgtttcagtatatggggaccgttttttgatcactttttctttgggcagcaacttactatatcagataactttgatgtgcctagtcccactctccactgtgatatgtacatgagttcccaatcccccttctgtatttggggtggcctccattggtcagctcctgtgtgcttcctgggccatccactttccatggtggtgcagctccttacctggcattcacatatgcgtattcctccttgtctacagtccatgtctccaaaactcagcagtcaaccaaggagagtcctgtagctttaggccgtggtcagctgaccctggagccatgtcccatagcatctcaccttcctcatctgctccaaagggcaatttggcaggtgacacctcattttaaggaaacttataattctcatatcttagtgaaagcaagaagttacaacttgggagtcaggcacccaggctcacttccaaaagagacccagactctgggtaccattacttcactgttcacatttccaagtccccaagaaagatgcttgcaggatgccaaattggtaaagagcttgtttagtttttttaaaaagattacatacatctcaaagagacagataaaagattattatttttttaaatctatgtattttattttatttttaaattttatcttataagataaaatttgtattgtattgtagttttttattttattttatatctatgtattttatttgtctgcactgggtcttagctgtggcatagcacaatcttgttccctgaccagggatcaaacctgggcctcctgcactgggagcccagagtcttagccactggaccacttgggaagtccccagagaaaggaattctaaaggaaataccctaagaaagggagggagggagagagttctctttctcttctggcatcagggaaaatcttttcctttcatttgtagtcacgattatgctgcccagggatgtcaggagcagagaggatccactgagggggcacagctgcctgggaggatggttccccagctggaagtgccccttagacatgggggctccagtgggctggccctccttttcctgttggctggctgccttcattctcaggccactggccagtcctgggacctcttgtctcacaagctgcctcaccgatccacgttcccacattttctttcctcatctccactctcttctcttcatctgaaacataccgtagaccacatggagtgaccttggaaacaaaaaagtctttcttatttttgagcccctggcatctgcaaattccagaaagtgtcaccaggtcctggggaaatgaactaaaatccagatacctgggaccctgcccaggctgattaaaccaatcactgggtggtttttaaagctctccaggattctaaagtgtagccaaagtgtcagttgaaaaccactgacggagaaacaacgtggaaggatgtttgtgtattagtagggagtgcagactggaccctttgagaagggagaaggatagtagattggagacttgaaaagacgctcggcagtatctgtctctctgggcatcctggggagggtacccaggagaagaacaggtcagggaccaggtaggagactggtggatgatcctggtgagagttgtctgagcctgggcttgggttggagcagcaggaccaggaggaagagtcagagaaggattgaagagggctttgaccttgctcaagctcatcctttccctgtctttctactcttagatttctgcagcctctaagtcagtttccagaataggagttagcgtgcacatcaagaggtgaggcaaatgtcccctcaagaaagggcagaaatatctgctttggtcatccatcaaattcaagtacaaggtgattctaacagcacaacagtaggagtgagagattctggataattttatctgtacccatttttgtaacatggttacatcacgtggctaaaggaaaaccagatttatgacagtaaagagcatcattaaactatttctgtttgtggttaacattattgtggcagatttgaagttcctgggatgggatgcttggaatcaaatccaggattgctgtcttcagttttcttcaccttgtttccaacagtctgtgaaggaaaaggaccagtttcccaacctacttgtcagagaaattttctaaaatggaataatagaggctttgtgctcagtccctcagtcgtggccgactctttgtaacccctgagactgtagttcgccaggctcttctgtccgtggaattctccaggcaagaatcctggagtaagttgtcatttagtgtggtgtttaagtcttgggtgcctgttgaggttcatggaaatcgcaagtataatctaatcaatcactatttctggctaattcagttcagtccagtcactcaatcatgtccaactctctgagaccccgtggacggcagcacgccaggcctccctgtccattaccaattcccggagcttactcaaactcatatccattgaatcggtgatgccatccaaccatctcatcctctgtcgtcaccttctcctcctgccttcagtctttcccagcatcgaggtcttttccaaggagtcagttctccgcatcaggtggccaaaggattgaagtttcagcttcagcatcagtccttccaatgaacactcaggactgatttcctttaggatgtactggttggatctccttgcagtccaagggactctcaagtcttctccaataccagtttttttctggccagtagggggaagtgtttgctgctcagtcctccttgcatccttacatccactaggatgtgagatgcccccctgcagggatggacagtatcttctctttctaattcatcctcctactttctgtttccaaccactgccataaaaaatgtttctcatttgtgagaattcagcaagaatgatggttgcatttctttttaacctggaaaaccttgatttactcttgcatctttgtcttatcggacattttagcaacacttgccagttaaccacctgctccgtcttgagatgttttattttcatgactctgaggatggtactctttctcgctcttcctcctacctcttgcggttccctctcagtctcctctcttgctttcctctctctcctccagagagactgaatatacaatgaacaatagtcagatcacgtataaaaagagaaccctgattcacagcctgagcaacctgtccagaaagccaaccccttgtctacagtaaccagcccaggaagccagcccactgtcggtcagacatgtaggcagtcagaccaccatctccactaacgatacagtaagctcattgataacttcagcaacaatgggccccaaatagctgggacttaataactgacagctttccaatttttgtccccacttccaacttaaggtcaaccagagaaagccaagtatacaccctaagcattcacataggaggccctgctgtaattaccaccattccctgcccaggtacttctggcttccttagtggctcagtttagttcagtcgctcagttgtgtccgactctttgcaaccccatggactgcagcacatcaggcctccctgtccatcaccaactcctggagtctgctcaaactcctgtccatcaagtccttagtggctcagaggtaaacaatccacttgccaatgtacgagacttgggtttgatagatccctgggctgggaagatccccaggagaaggaaatggcaatccgctccagtattcttgcctgaagaatcccatggacagagcctgggaggctacagtccgtggggccgcaaaggagtcagacacaacttagtgactaaacagcaatgataaccatgtacttccttggtggtccagtggctaagactccgtgctcccaatgcaggggtcccaggttcaatccctggtcagggaattagatctcacatgctgtaactaaaagatcacacataccccaactaagacccagcacagtcaaataaatgaataaaatattttaaaaataataattacccccccacacacatgcccccatagctctcctaagcccacagcaccaaattagggcacactgaagccttcatttttaccactctgaagtttttgcagtctttggcctgcctttgaatctctgccaaagtgcaagtgatggtggccaactctcttgctgcagaaagctctgagtaaataacctttgcttttctcatctggttggtcctcattcatttccacactcctctgagtagctcagatggttaagaatctgcctacaatgcaggatacccaggttcaacccctgggttgggaagagcccctggggtaggaaatgacatcccattccaatattcttgtctgaagaattccatggacagaggaacccggagggctattgtccacgggggtctcaacgagtcagatatgactgactaacacactgtgaaactcgaatccctggagtgtctccagacttgaacagcagacctctcttctccagctacccttcctccggggcggcgggggcggggacggtctcagcaggtcccctgacatgaagccttgttggaatactaatgacatcccagagtgtatatctctgagctccacactcaatacacaagtgcccgcttctagacttggacttggaaaggcatccctaactctcacgttcaaaagacaaattctttcccatcttcctcatcccagttaatgagacacagccactcagcctttgctgctaccccgactatcttaagctccttttctcacttcttggactcttgggctccgccactttatttagaaccattcagtgacttctggcaggtcagcctcggaatgtttctatttatttagtgtccccacccttctttgtctcctctgctacaagcccagttcagacctcgccgtatctcacatggcccatggtgttgagtgaaggaacaagtaaccgggttggtctctcagtgacctccagtatctgactgtccccaggggttctaaagagccttgtcagcagatgtaatttatcttccaggaaaatttgtgattacatttcatgaaagatgtgatattaacaaggggttggtgaaatgtcaaggtaactaatctttgagttggaactctcgataaaaaagaagccaaaaatttccatattgcaaaggttctctgcatccattcctccttagaaacaccaaggccaaggactgatcataaaacacttattaattctcctaggttattattgttctatatggtatgggttgcttgttcttatagaactttctctctgtatacatatgtacatatatgtgtgtgttactaggaaaaagaataaagttatgattaaccacataactgaacccaactatatgacaactttacatcttgcaacatgtattcctgacgtttcgtatttataaaatattataaaaaccctctgcacccccaacttgattctatttccttgcctctctctgtagaggcaactgctatcgtgagtttgctacttataatttcatgtgtgtttgtatactcagattacattttatgtctgtaagatataatttgttttactgttggtatatttctaaaattggtatattttaggtattatttggcagattacttttcaaattcaaattgtttcttatgtttacccatgtggaaatatattccgagtcattctttatgcatccctgttttctttccatcattgaggtttattgacttgtacagaaaagtagataaataatgaacaccagctcaatcaatttacgtaaagggaacatatccatgtaaccacaaactggatgaagaaataaaatgttaattgcaccccagaagcccacacatgatctcatgtagccatcatctgctgaacttccccaacggaaacatatttttaagttctcatgccatcagatcagatcagtcgctcagtcgtgtccgactctttgcgaccccatgaatcacagcacgccaggcctccctgtccatcaccaactcccggagtttgcccagactcacgtccatcgagtcagtgatgccatccagccatctcatcctctgtcgtccccttctcctcctgcccccagtccctcccagcatcagagtcttttccaatgagtcaactcttcaaaaactctatctggggacttccctggtggtccagtggctatgactccttgctcccagtatagaggacctaggtccgatccctggttatggaacaagatcctgcattgctgcaactaaaagatcccaagtgatgcaactaagacccagtgcaaccaaataaaatattttttgaaaagaactttatatggaaggaatcagagtctatatagccttgtgtgtgacttctttggctcaactttgtatttaaaaaattcatctatgtttttgcatagcagtagtttgtccatttaaaattttccctttagtagagtttgtttttagaaccatgttagactgtcagaaaaattggagagatagtatagagagtccctatatacctggttcagtttcccttgttactaacctctgagattagtatgtacattaaatgaacccatatcgataccttattttaaaagctgtgatttatttagatattgttagtctctgcctaatgtcctttttttccctgttccagggtcctgcgtgacgttcagttgtcaggtctctttaggctcctggttggtgtggcagtttctcagacatttccttttttgatgctcttgagcgtttctgtgagaactgctcaggtattttgtggagtgcctcactattgggatttgtcttgtgtttttctcctgataagactggggtctaggttgctgggaggcagactaggaggtgaagtgctcttctcgtgacaccatacccagcacacgtactgccaatacgactgatgactgcggatggtggctttagtctcctgcctgaagtagcgtttgtcaggtttctcgcttgtaaagtgactccttttctctccctgtgtgttgtacggtttggaagaaggtcattctgcacagccctcacctacagagtgaggagttcattccctctccttggaaacagaatatctacataaattccttggaattcttctgtatggaagagctgtctccttcctcattaattaatttattcaatcacttatccacgtcaatatggactggtagacatttactttatatattctgggttacaatccaatactattttattttgttgcccagaagttccagctttgacccctgggaactctttcgatcgtctctggtggtcctttggcctttgacatacccatcaatgctttgttctgagctcttccttactttcagggactacgaggttatccaagctcatcttgtatatttcctgccccagtcttagaatcatccatttttccaaggagccttgattcattcgtcttaatagaaaatggtgttacaaacaaaaacctggctactagactaagcttgttgatactggggtgtcattttttataagacttctcagatgacagagcaaaaaatatatgtgtttgtactaagcagtgtacatatacttagctataaacatgtgtatatgtaaaccatctgtatctattttaagccaaacatgagttcatatgaatatctcaaatccattactacatagatcctacccttgttataaactcccactccaatagtgagataccggccatccattagcgtgaatgttccaatccagggtatatatgtaacagtatcagaattgttaaccaataccccaaaggaaacaactttatcaactagggtacagagttcctttcacctgtcgtcttagagatctcacccatttccacagacacttagggttacacctcctcctgcctcccctatccatccaaccctttcagtgaggttgttttatatgttttgaatacagttaatttctcttgtcacagtctgcattccttttagatttcccccaacttctaaaatgattttttaaaaacttgcagtcattaaatttctctctttgttccatagcttttgacaaatgcatactatcttgtatccaccattacagtcattttattgccctaaaagcttgctgctgctgctgctaagtcacttcagtcgtgtccgactctgtgcgaccccagagacggcagcccaccaggccccgccgtccctgggattctccaggcaagaacactggagtgggttgccatttcctcctccaatgcaagaaagtgaaaagtgaaagtgaaggcgcacagtcgtgtccaactcttagcgaccccatggactgcagcccaccaggctcctccgtccatgggattttccaggcaagagtactggagtggggtgccattgccctaaaagcttacattacaacaattttattgccctaaaccgccccccatggtattcacccttcccctcttgctcctgaaccctggtacccactgatcacttactgtgtctacagttttacattttccagaatgccatataactggaagcatactctgtgcactctttttatacagacttcctttacttagcaatatgcatttaagaggcaaaaaattaaccaccacatcataatgttaatatatactaatatgttaattatccccactgattttctcatattatactgtgttaaaccaacctggcattcctggaataaacctacctctactatgatacagtgcttattttagaattgctggattccatttgctaatatttcacctagcatttctacatctattttcagaagtaatattggttgtgattttcttttttcctttactccctttttccatgtggtttggcattagaatattcgaggttcataaaatgagttgagttgaggatttttgactgttcttcatttgagatttctttacatgtttcagagttttgatttttaggtttgtttttattcttttcatttttctgcccacctgcctccaccccatccaatgaggctctccctgatgatcattctgtgatagcttttccctggactctgggacttcatcctggattttatcaaggtagtttggggtttctgacccaagagattgtagacatttgcaccatcgtgagaccagtatatgactatgcttagtttttagctagggttcgagtcttcagcctcattgccccagaccctcattcttctaaaatcttgggctccagagagtgtaatccatgatttcttttttcagggctccccggagttcctgacttaagccatgtgcctggttcctgtctgccctcttgggtgtgtttgtcttgtgtttgtcccccagggtttgccccatcagtttgtctcgttgattttagacaaagagcccagtgagtcagaggcttctggcagttttcttctgcctctgttgagccagacatctctttttagctttctatttttacaccttatctgtcatggctctgtgttcagagcaaaaggatggatcaaagcaagagctcattgagctgtcctgttcaaaacactcttccctatctttcttattttcaatttactgtcttgtggcctaggaatttaaagaagctatttgatttcatgacaccaatacaatgagtcaggtattcttatcaccttgaatgacaaatgagcaaagcaagaaacagagttcaagtgcttcacttcaggttgagtgaacggatggttacctgtgagcctgtgcctcacattttatcaatactttctatcactcttgctaccaagagaaggagaacactgaacaatcacggcattcattaaagacaactcccctgaccgatttctcaaacctttgataccttgagcattttgtgatttcaagagtagtatcagaggggaaaacatcccagctgctgtcacagcactggattttaatttagatactgtcatttccacttactccacccatttatctgtcttgtctgaatttccatgctccaaaattctcttctattccattcaattcagcaaatgttcactgaagctctgtcatgctcaaatactaccaggtgatatggtctggtctgtgactggcccagaaagagacatcccccaaatcatggatagatgttgatgttcagtcactaagtggtgtccgactctttgtggccccatggactgcagcacgccgggcttccctgtccttcaccatctcccagaatttgctcaaattcatgtccactgagcccgtgaatagatgaatatcgagtccacaaatagatgagcaaccagttatccgttcaagaattatctaggcatccctcttccacatgccaagctccttgctggttgcagtagagaacagaaaggcaagtccatcgggagagcccatccttctggagcttgttgctggaagagaactggtaaggtcattgattactgatgagggaggcagaaaatgacaagtggcaaagtggaccttgcaaggacaaaggaagaggggtcagattcgaccaggagatcagcccagaaactcttgtgagattcccggtaaaagttgatacaggctggcctttggtagaggcttcagaaatgaaaggagaaaaaaacagtcccgagatcattaagagggtggaggacaatggtcagaggtgatgctctgttgctgctggaaccttcaaagccatcctcagcaaggagagaagaccgtttctgctgggaagtctttctgtgtgtttgggggggatgtggggaaggttagcaagagaaaggatattttcactctaatctgcaaggtgagtggatctgaacataccattgactgaatgcccttcaacctacccatagaggaactcagtaaatactgaattgaactgactagtcatccaaggagaagatttggttattgataaaaattgtaaggaaaggagtctgagttcagactaggacataacttagaataatgattcagtttcaagatcaagattgttatcaaccaacaaggacctactatacaccacagggagccatactcaatattttgtaataacctataaagagaaaagaatctgaaaaataatatataaatacaactgaatcactgtgctgtatacttgaaactagcataatataaattgactttacttcaataaaaaatattttaaataaaatgaacaaaaagtttaaaagttaataaatgaaagattgctatccaaatcttttcactgtttacaaagcttgcacttaaaggtactttggaatttgcctttctaaagatttcctttgaatattttccctctcattcccctttgagtcatgccagataccactcttgacttcttcacttattccttcaattcccatggaggacccacagaaacccacatgaatctagacttccaggctgaggtcccggttgaaataacacagaaaccatgacaatggctgtgttagaaaggacagatcacttctaaaacggtgaccttcacacacatccccagaaaggctgcctatgctgattttaaattcaggcttgccaatgcccttccatttcaggcactttggccacaagagtgcttctgtgttatcaggaattggaggtacaccaaaataatctctgacaggcaaagaactgaagagatgctaatctctctcctgcatctccttgttctttggctgagtaaagcagccagcacatttctacctttgtgatcttaaatccacaacatttaaaaggattagacatatgtcagtgtaaactggatggacggagtcttaaaaaaaaataaacacgagggaaatgtttgtattcaaatgtcaaacactttatgtgtcgatttagtgctctttcttagccataaataacattccaggctgtaattaatttatccatgttcctatcggcccagcattattccagggcataaaggggtggagaaaggcggggtgggggtggggggtaaaccaatactgttatttcttttggaaaagctttcttaattggacttgtgttcttgtcataatgaggtgaaggtcattatttgtcaaatgcaagggcagctgtgctgcctggattcgtgggtctgtagccagacgtgtcgtcctgtttggatgactcaagggtgacaaaaattaatgcaggtgccccaagacctggacagctgcagcttagtgagtgttttagtggatgatcttgccatccacccatcaggcaacattcagtggaaccagtcacagtaccaccccatagaattaatgctatagaattgaatttgttttatgggagaggcagtccctgctctaaatcctaatgtaacagccacgaatcacccagcatatcaggggtccataggtctgcagaggtatagggaaaatattgcccatgtgtgcctttggggtgagggttggggagagtcatagcttttctcagattcccaaaagaatcatgaaaattcaagaaccattgctctgaaaggataaacagaacatacacatcagttcagttcagttcagttcagtcactcagttgtgtccaactctgcaaccccatggactgcagcacaccaggcctcatgtccatcaccaactcctggagtttactcaaactcatgttcatcacatcaatgaggccatccaaccagctcatcctctgtcgtccccttctcctccggccttcagtctttcccagtatcagggtcttttccaaggaacagccagagaaaaggcttttgcagaaactttgttctggaaggacctagaacagaagagacaaactgaatacccacagaaccaggcaggacattccataatgtcctggaagcaggcaggcctgctaagtgtccttgttagtaaaagtgttagtcagttcatgtctgactccttgagaccccatggactgtagccctccaggcacctctgtccatgaaattctccaggcaagaatactggagtgggtagccattctcttctccagtggatcttcctgactcagggatcgaacccgggtctcctgcattgcaggcagattctttactgtctgagccaccaaggaagcctcagggagaacacagagtttgcatttttctggaaaggggctgtgccattaactcctgtcacttgaggttctgataaatacgggcatgaagtttctagatccattgggtttgatgagagaagccaaatgtctagatctttagtataagagctctccatttttttaatttgaaaaaccaattcaaaattaaagcaaacaaacagaccctctgcctggaggcttgaactggcccgcattccctcctctaaggcctttgcagaagatctgggatttgaccaagtcctgaaccccagttggaggatgatcatcgacctgtggtttgggaagctggaagcagagggctgaacccgaggaagggtgtgaggcaggggaaaagatgggccatgcacagaggggccacgtctgctgctccaggagctcagaggagcagagatgtgggaaatgaggttagggagctgcaatggcctgtaggccccaagcaggctggggatggtttctttttggaccaggagcatcccttgagagggtgttaggaaaatgctgccattgggaaagatgcatcttatgcgcaggactcccaaagaggaaccccaggggaaaactgaagctggcctcctgtgaccagatgaatcagatgggagatgtcggctacaggaagagggacagataagatgtgagcgtctagtggcccgcagaggagacacaaacaggttcactcatctgtgagggatgctgacatggctggagcagctctgggtgggtgggggggagtggtgtcaggtcccagatggcatcaccaggctctcttccaccattctgcatctccccacctgtcaccagaggcaggagagggacttcaatgtcctcctcctcctccttgtccttcttggggggaggaagtattacaatttcagcacaatgcagcacccaggttatgccctgcagctgctcaagaaaagttgctggctttccaggcgttcttattgagaggtgagagctgcacctggggatagtagcagccctgggggaagggtcaaaaagcaagaaggaagggggcctcaggggagggaatgtccccaggttaatgccggggcatctggatgcccatgggactgcagccagggggaacagagctgtctgcatgatgccaggctccatatgtgtatccagggtgagttccaacgaagacggtcctctctggtgagggtggcagtgtgtggaaagtgttgggaatgtgaccaggctctccaagctgtgatcttgctcagaaagaatgagaagtggccggagctctggcctcggatgtcctctgcattgaggtggaatgcaggaagaagaggaataaacccactgaaaggagaaggctcaagtctgtagaccttcttcctgagaccaagaagaagggaggaggtgaagagccagaggaaaaaaaataacgaaatgactcaaggactctgcagctctgttgttaagattgtttaaggccagtcacacctgttaaatgggaagaggcaaaaatgagagcgtaaaagaagaaggaaagaaaagaagccacttcaagttcgccaaaggcgacaaaagacactctttctcatccataatcatgttttatcattacaagcaggaaatgacagcaacagcatcaccagcaataaaatgactcatcacaggtgggatggagagaatcggagtgagaaataaggacgtcagcattcattagaactctgcgcttgcctccacacacagcggagcctactgtgcagcagagagaactcacccatcacccagctactgtgcagactctatatttgtatgtttggaaatgtcttcaaaaaggtattctgtgaatggcaatattttttttcccacgactctcagcatgcaggatcttagatcctccaccaggaattgaacttgggctccctgcagtggaagcaagcacagggtcctaatgagtggggatgttcttatttctctctctgattccatcccacgtgtgaggaattactttattgctgataatactgtcaaaggttgagacatcaccccaatccctgacaaggaggggtctctgtagatgttctggggtgctccatccatgcatgcttacctggtccacaggttattactgaaaaggggagcatgtaagttcaagaggacaaagagttttgcttcaatgatccatttttttccttcttggtatggagttctttgtgaaaaggtaagcaaaaaaaaaaaaaaaaaaatactacgtacatacagcatgaccttgagggagtagaatctagggaattttcagatatagtttatgttttttcctaaatattaaagaatatagttgctacaaaaaaaaaaggaaaggaaaatacagaatggtataaatatgaaaatgaatccaatggaagccatcagtagcagataataagattgtggtatgctatcttacagtctttttaaataatgcaaagaaagtagggaaaaccactagaccattcaggtatgacctaaatcaaatcctttatggttataccatggaggtgatgaatagattcaagggactatatctggtagactgagcgcctgaaggactatggacagaggtttgtaacactgtacaggaggtggtgaccaaagcattcatagaaaaagaaattcaagaaggcaaaatggatttgtgatgagacctcacaaacagctacgaagacaagtgaaaggcaaagaaaaaatagagagatatggccagctgaaatatcaaggagaaataagaaaaccttcttgaatgaacaatgcaaagaaacaaaggaaaacaatagaatgggaaagactagagatttctttaagaaaactggagataccaaaggaacatttcatgcaaagatgggctcaatgtaccatttagggtttgcatttttcacttaacagtacaaactatttgtaaacattgtcccctacgttgttaccagctatttgtaagtattatgctaatgaccacatacaatattccagtgtgtaggataacattctaaaatacctaccataatgcaacctcttttctattttgagacacttagattctagttatttaaagtaaaactgcaaagaacttttctaagcataaagctattctacaattcagattcccaccatagaatagatttcacacaatataagtgcacatcaaggccatggacccttgagggctttccagagtggctgtatgggtttagactagcaaccatggtgcagggtagtgccagcttcacttgtacccactgggctgcatcctaaggtgccacacccattggaccgcttaccagagccttcaatggggtcctccccaagagaattcccaggtggaggcacaagaagtgactggcatccctgaaggctttaggcgcaggagaaaatgtcttgtatctctaggtcaagaatcaaatttctctgcttcctgcctgcggactgcaagcctggaccttgttccctagcactttcaagggactgttatttaggaactgcccctctcaagctggtctcccccaccacctccaggctagtgggcagctgctggaagatttgcctggaggttactggggccgtggcttagtttttgcccctgatggccctaaagtctgttgcccaccacctcaggaactttgggtctgggctgccaaggcatggatggctccagtcacacctgtgcaccctcctacactgccctcctcccatctgtctgatccacagctgcaccccgaactcaggacaggacacctggtcagtgggtgctcaataaaagcttgctgaataggtgcatggccactagtgggtttcaactgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgtgaagagctgactccttggaaaagaccctgatgctgggaaagattgaaggcaggaggagaaggggatgacagtggatgagatggttggatggcatcaccgactcgatggacatgagtttgagtaggctctggggagtttgtgatggacagggaggcttagcgtgctgtagtccatggggtcgcaaagagtcagacacgactgagtgaactgactgggtacagttaacaagggtcagctggagttttgaaaagcgtccttgaagtgattgtttggagctgtttgcaaaggagtttagtgagtgcctggccgagagtaggggggggtctctgggactgacttctcttggccactgcggtttcttgtttgccaactccacccccaacctcccacccccaggaaggtctagccgtctggctgtcctgctggctggcagttctaatacaaactctcggcggactctgcgcctactccgagtgccagagcatttgctggggctaaacgcagggtgaggagaatcggggtgaccccggggctggaccgaggtgtcctgggggccgcgggcttggccgggacgctcgggggatggggcggggcgccctgtgactccgaaggccccgcccgccccgccacgcgctccctggccgagcgcgctgcctgccgcgcggttttctgtgccctgcgctcgtcctgcgcggaccccgctgcgcacccggctctctccgcgccccagacccggtaagtcaagggctcgtgcctcccggtttctcgtctggcggcgcgcgatgccctaaatcgggcgaccctgaggggagagtccaggcacagggtctcagcccctctgggctgctgcgggtgccccaggcagggggcacagcgacccccttggaaggcagagtagatgaccctggctcatgccttcttcccctctgtcctcttcacttctagaacgcatgcagagaaaaatcatctcagggccaaataacaactttcccccgttgttattaaatgacagtcgttcctgtagaaagttggggaaatacttaaagacatccaaagaaaactaaaactgcccacgatcttagcccccgcttgggttcagagacctccagatcaggcaagacgcatacacaccggcctcaaaggggactttttccttttgggggaccagaaaagttcttgggccttggcatgtccccagggaaaaggcatgggacacggagaacattactgatatctgatcttgattttaagtgggggaagcctggaacttttagaagaaagttgacctggtaccaatcacctgttatgtgcccaggctatcaggtgctaacccacccacccaatccccatcactcccaagctccaccctcgatttttttagactgctgtacctgaactgaccatttgagtcccctttcaggttaataaagagcttccagctccataaaggaagggcttgtcaataaccacagctgttacttatggtcaggatgatggggaactttgctgtggtcggccactgctttaaatcatgtgatcaataaattgccagcaggtgcagtggactctgatctatgggcttctaaccggggtgcaaaacccttcggcttgctctggtctgtttcatgctgcccatcagagatgagctgaggttgggtctgaggaagtcaaccttggtttccagaatattcaggttatctctggcttttgataggttcttaggaagtggattgttttgaaaataaagtacaccgtgaagacctctaagggactcgcttttgtcatctcaagtctctgaaggcagagctggtgagacagtttctgtgtgtttggggctttctgggagttgaatgtgacatttacttacgcaggtattcacacatgcatgcctgcatctgtgaatatttactctgttcctgccgtatgccagacatcgttctagtctttggggtacatgggaacaagacaggcaaagatcctggccctccaaagccctccaaagatagggaagacaaatgataaacaatgaacacaagaaaccagaaaactatactgagtgcagttgataagtgctatggaaaaaggcagagtaagttacgggaaatggaagggaggagtaaaaattttgctgtattgacaattactgatggtcttaaacctttttaggaaaagaagagttgcatatatatatatatatataaagctatattaatattatatataatgcatgctatatataatataagatacaactatattaacataaagtttaatatataaaataaataatgctaactaactatacataaaaataatttaaattttattacataagaacagactacattgaaagacgttttcattgggttacccactaagctctttccagtgtgaattctactttattgattatttgctcttcacagtcatgtcgtagttgattgcactttcctacttaattcagcaaacccttactgagtcattctggagatgtgagtgaggtcaaggtgaacaagacagtctctgaccttactgagccccctggaaatgcacagaaatgtctacaaaggattgcaacacaacttagaatctgggcagtagagacagagcactgtaagggcccagagcagaggaggggacttcttaaaggggcttcaccagttggctcagacacgcgcttatggtggactcatggaattttgacaatcaaacacgggggtctcaccttttttgcagagaaaccagcgaaagtaaaagacaggaaagctgtgggctcattccatgcctcctttaaaccctgtagtacagtcagggagaatcccattaacctcagttttcagatgaggaaactggggctccccgagttcatttaatttgctgcaggtgagattcttccttctctgtgacttcatgtgtcctcccagagaatgcccttccattctccatgccaaaaggctcgtctttttcacacacagagtttgacccagtccctctcatcagctccctggtttccatctccacccttcacacctcagagttcctctctgtaacccacagagaggtctgagaagctcttggtcctacgaccagactcaagagccagcagggagtccttttccgatctttgagggcagtcggatgtcatgcctctgtacaggtttcatcctgattttttgagactatgcgagggaaggaggtaaaaagcccaaaacaaagccagctgactgcctggaagggtctgagcccctgttggcttctttgctgccgagaggcaatttggacattccgtgttcagccacccagtcatgtctgactctttgtgacccctatagcctccagaatgccaggcttctctgtccttcactatctcctggaatttgctcaaattcatgttcattgagttggtgatgccatctaaccatctcatcctttgccaccctcttctcctcctggcctcaatctttcccagcatcagggtcttttccaatgagtcagctcttcgcatcaggtggcgagagtattggagcctcagtttcagcatcagtccttccaatgaatatgcagggttgatttcctttaggatggactggtttgatctccttgaacatagtgtgataaagatgaaaacagttgacagttacttccaaggaaaattggaaatttctcaccgaattcttgactcagtaagatcctgttcacccaaatgaagcttatccataattgtttgtccctagttctgcttcctgaagcaaataatattgatttcaaaactggttgctctttctaggaaaggcttagggaatgctgtcaagcgtgacgggaatgtcacccccatcccaccgctatggtccccgggagcctcctggtttcactagaactgagccagggctggaatttgtatccctgaccttcctccttcctggactccaccccagaatctggccctttcagcagagagcttggagtcagccacaaaagccctttcagtaaacgcgtaggaaagggtgagaggtgcagtgctgggaaaactgctctaaaagcctgttatcagtgctgatatgtgacagagccggaactccagggaaaaatgcagaaggtgaggcctgtgctgggaatacagtgacatcacttgctgcccccgcttccccctgctacaggggggcagtgccggaggcctgcttggtctccatttgcaactgttcagctcatcccagcagcccacagtcatgaatcctgagtgagtcagtggaccagaagccctgggactaagctttgaaaaaaaaaattgcactaaccttaactggacagcaaggagatccagccagtccatcctaaaggaaatcaaccctaaatattcattggaaggactgatgctgaaactgaagctccaatactttggcacctaatgagaagagctgactcattggaaaagaccctgatgctgggacagattgaaggcaggaggagaagggggtgacaggatcggatgttggatggcatcaccgacacgatggacatgactttgggcaaacttcaggagatggtgatgggcagggaaggctgacatgctgtagtccatggggtctcaaagagttagacatgacttagcaactgaacaacaaaccttgattaggggcagtgagaccctatgaaaggtctcaaacccaagcagaagcagaaacttctggaaccaaccctcccctctttctgggcccaataaggccagtttgaaaatgttcagcacaagctgagcatcaagctggttgtgtttggagttggttcctgcttcctgcttcctgctgcttctgcctcctccagccccatattccctgagcgagatacaaaaagctgtggttctccctggtccaggagagggttcatctgttgcctatttagatcagaagccagtccccacttgggtagacccagttttatctgatacaagtggctggcttctcagtttctttgagcctaaatacagatccaccgtctctctgcaagatccggataactcccttttctgtgctaataaaatgtgagtccatggctaaaagattaaagtttatgggtgcatttttaataggagacatgacttcaagcaagtcagctcacctctatccagcccagttttctataaagttaaggtcgttgaatcagctggtctccaaatccactggagtccagcagtcttaactgtggccaccaggcagtgctttggcattataatggatgtgaacttagggaatgggccacagcccccagctgtcgtgcagattaggttctgtgtcatttgtaccgtgctgattattagaggatgttgccaagctcatcgtgtgactcattatgcaaacacaccatgagactcagcaggcaagccttgggggcacagaatgcatttagcaaaagtgatacaataagtgtaaagtcagaagagacttttcgttaaaaataacagcattgttatttgaaaggcagttaattcacttggcttttctggtttgccaccaagttctgacaggctcagcagagatgccagcgtgagttcagatgggggcagctgaggtcacggtgatgacttaggaatttttctccaaaactcctgttcaggttgtatgatggatgcacaagactgaaaaagaaaatctgaaaagcaaacaagattagaaaattatgctatgaagtttctatttctcttcttagaaagttcttccaggtattcagggagcacaatacactgattggtcagtttcctaagggttagggttctcaatcacgactaccaagtaggatcacctgggaagtttggaaaagtcgcagtgccagacaggaacccaggccaagggtctctctttctcttctttacaaggccactgccttgtcagattagggccttaccttcaggaccatacctaggtgcttcagtggtaaagattccacctgccaatgcaagaaacccaggagacgcaagtttgacccctgggttgggacaatcccctggagtgggaaatggcaacccgctccagtattcttgcttggaaaatttcatggacagaggtgcctggccagctgtagtccatggggttgcaaagagtcggacacaactgagcgactgagcatacatgcacaaccttaattagctcctaaagaccctacctccagccacattaggggttgcagcttgaacatatgaattgagggggacacagtttggtccatagcacataaactaaaagatacacctatcacaaaatatgtgcattcaaggagctcttcctgctgatcacctgcagtgacaggggctggaaatggtgaatagaaataaatgtgaatcaattaatcgtttgacccatcaagagagggcactgtgcagatcccaggtggcacatcccataacagatgcgtgtggttagggtacgccgtcactgggatttttaaaaaatctgtgtggtgtgtgtgtggtggtggtggctggtggggtgggtttggggccagtccatattttgtgatttcaggttgcacttttctttaagacagttttcctgggaagttcaccctcccggagtgaaacctgactctcaggatgatcctgtctaacgccacagctgtgacacctgtgctgaccaagttatggcaggggacggttcaacagggcagcaacatgactgggctggcccgcaggttcccgggccatgaggacggcaagctggcagccctctacatcctcatggtcctcggctttttcggcttcttcaccctgggcatcatgctgagttacatccgctccaagaaactggagcactcccatgacccatacaacgtgtacattgagtccgacacttggcaggagcaggacaaggcgtactttcaggcccggattctggagagctgcagggcatgttacgtcattgagaaccagctggctgtggagcgacccagtgcataccttcccgagatgaagcggtcgtcctgaccccaggaccagtcaaaactggacagagcctccctgatgagctgatttttctaatcacatgttccttttttctttattgtatgagtataattggggtttttgtctatcatagggggtgaaagggtgatttaatgtcactatatttctaaaatcacattccttctataatagattgtcagtcattccccagtatccgtgactgccttgttaattgcagcaaaatccctgcaatcatggcctctgagaataaaagccatatttccctgactcccttgcagctagcaaggtcatgtgtatgaaattctggccagcagaagggggagtgatgagtgcagtttcccggtgagccttgaaaaggaaaggatatgtcccccagccccctttctcctttaccactggctgggacatggatgaggtggtgagccagctttgagtctggaaaaggactgtgttttcacagatggcagagcaacaggagtctgggtccctgggcaatggcatgggccagggtctggtcaatcaccagctcaaacttcacaagaatgggaaaccaactctgatcttccttagccactgtcattttggtttctgttaaagtaacagaatgagcttccctagtggttcagtggtaaagaatctgcctgcagtgcaggagcctcaggagatgcaggtttagtccctgggttgggaagatcccctggagaagggcatggaaatccactacagtattcttacctggaaaattccatggacagagcaacctggtgggctacagtccatggcaaagagtgggatatgactgaagcaacttagcatgcacacacaagtaacagaatcaacatcctgatgaacacacctttcttatggaactgagaccgaaggcataacattcccatatttgtcacaagcatgctttcccccttgttacaggacatccttttccctttttacttgtaccctcactacagaggctccatcctctctatgctttcctgcttcccactcctcccttatgaccatcctacacacacacaaccccttccaaaacacacagacacaggctcacacccacaggcacacacatgcacacagaaacacacacagatacataaggacacacacacacacacatttcctactcacgtaactcaatctcagtgctgcaggattgagatgcaggaaaaaaaaataatcccacttcagaatgtgtaccaagggggaaggttctcaggtatcatggtaggagggatggtggcacccaccacctcaagatccctgggagggacttccctggtcatccagtggctaagactctgcattcccaaggtagggggctggagttcactccctggtcaggcaactagatcccacatgccacagctaagacccagagaagccaaataaagaaatgaaaaaaaaaaaaaaagacccgggggaaggtgtgggtgtgggcagggggcaacccaggggactggggtggcagggccttttgagatgatgtgcccaccacagttgaattgtgtccccctcccccctccaaagacaccttcaagtcataacccctgcacctgtgaatgagaccgtacctagaaataaggcctttgcagatgtgatcaaggaaggtacggtcattgttgtttcatcactaagtcgtgtatggctttgcaacccccacagactatagccttccaggctcctctgtccatgagcttttccaggcaagaatactcgagtgggttgctattttctctatagaatcttcctcaacccagggattgcacccttctctctgcattgggaggcggattctttactgcagagccaccaggtggaccctaatccaatatggctgatgccttataaagtgaaatgaaatgaagtcactcagtcatgtctgactctttgcaacgccatggactgtagcctaccaggctcctccgtccatgggattttccaggcaagagaactggagtgggttgccatttccttctccaggagatcttcccaacccagagattgaacctgggtctcctgcatcgtaggcagatgctttcccctctgagccaccagggaagttttcgatgtccttataagaagagggaaattcaagcagagactgggtgatgcagcagcacaccaaggacagccaaggactgagggtcatgcccagaacctgggcatggaaggactctcccagacagcttttagggtaaacgtggcccctagacactgtgctttcacacttcaggcttccagaactgcaaaaacaaggggtttgtactgattgaagccccttaggtggggttagtttgttccagcagccaccccagctcgggatagcgtgttcctcttggctcttcacaagacagagattcccttggacacttccctcccaactggaggatagggaaggaattcaggggtaggggcagatggttccagggacttgctcatggcagcagaaagatactcatgagcctagctgagaaattcacaggacatacacccttggtctcagccttcttccccagaggtcctgggtcacctgccccgtcctgaatacttgcctgcctgggcataaagaggatggaatccttacagaaaacatacttgttagaaacctgcatataaaataataaaaataatataaatatttatgttataataaaaataaataaatgcacatagtataaattcgaagcaatacccaaggattgcaggtcatcctcagatagaccattggtacccagtccttgcttcatgtaatagacagtgatttcttcgtgagcttgaaggtggggttcctgacggagcatctctgaggcggaagcctggcaaggttactagtctccaagaggagtggttatttgcatcagagtactttgaaaatctaatgaaaaccatgatcacccccctcccacccccccgccaagttgcacacagacacatttttacccaccatcttggggttcttgggctgctggaagcccacctgtgatggctggtatctccagccccatgtgaccgccctgctgtgacagacacagatgacccctagtgcaggaaagcaggctgagtgtgcaggtttggagagggacccagagcgcacgtggtccacaatgtgaccctcagcggcaggcagactcggggattccaggcacacagaatagttgtttatcaccggttcacgttccccaactgagattcctgccccatttaaggcaggattcctaccccatgagctatagtcctccccgtccttgaaggaccaggcgtttaactcacttccccatgtccatcaaacctcttataagccacactgtgttcaaatgcttgttaccaaatttaaaattttgctttaacatgcatggagtgctaactatgagccaggcactgttctgagctctttaaaaccagaatctcagtgtttcatatgcaatagttgatgtgtccattggataggacaacaggtgttttgtgataacaacatcttttaaaaaaaattagagtcttttagcatgatctgtggtgtgtgttctgttaatagcattctgatactttttaaaaagtcaatgtgggttcttgggggtctctgcccaggcagctcaggggctctggaataaggaagtgtgattgcctatggataaattcccatcgacacccctgatcctacagcgagaaagcaaaggagtaaagtcccaggtggaagactcctttgaagggagggttgaggctgtcactgggtcccaggtattctcagccagccagaaattcaggcagagtctctctctctctttcttttcttattgtagttgatttataatgttgtgttaattttgttgtacagcaaagtgattcagtgtttatatatatatatatatacatacatacatacatacatatagacattcttttggacttccctggtagctcagctggtaaagaatccgcctgcaatgcaggagacctgggttcaatccctgggttgggaagatcccctggagaagggcatggcaacccactccagtttctggcctggagaatcccatggacagggaagcctggtgggctgtagtccatgtggttgcaaagaattggacacgactgagcgactaaacacagcacagcacagacattcgttcacatgttgttttccattatggtctatcccaggatgttgactatagctccctgtatctatagtagggccttgttgcttatccattctatatataagagtttgcctctgctaaccccaaactcccagtccatccctctcccaccctccttgccccttgaaaaccacaagtctgatgtctacatctgtgagtctgcttctgttttgtaaaaaacttcattagtttcatttttagatttcatataataagtgatatcacagagtatttgtctttctcttcctgacttcatttagtatgataatctttgggtacctccgtgttgctacatggaatgaaagaatgccgcttaatttctttttagtgattgagtagtgttccattgtatatatgtaccaaatctttatctgttcatttgttggtagacatttagcttgtttccatgtcttggctcttgtgaatagagctgttatgaacacaggggtgaatgggtctttttgaattatagctttgtgtatgagttttgggcagagtcttggtggactagctggtttttaagagaagttggaaatctggatactatttgaaatctcctgatttttaaaggttggcaactaattcaatttttttaaaaaaatgtgtaggccgaacaaaatgtgcccttgaactgattctgctcaaagacccgctgacgtacaacctctgctttgaggagcaagaatagccccaggccagccccacagcacacttgatagaaagctgagtcaaggagactatcctgcctctgcagggctgcccgcctgggtggcagaggcaggcaggatcactggcggcagctgacgaggcgtggtcctggccatggaccctcagagcccggtccccatgatgagggacactgcatcgagctgtcttcactgacacctcccatttggatgccaggaccctcactctctttggtatatggtggtggtttagtcactaagtcatgtccgactcttgtgaccccatggactgtaacctgccaggttcctctgtccgtgggattctccaggaaagcatactggagtgggtggccatttccttctccactcttctgtatagaatagggcatgatctccagctttgctctgtagactcagaaccagttgtggaattccatctgaagaagtggacccactctatgagcagacaattcaggcttgtgagcctcctacaggactgaggactgaccgtgagctgggctgcactagccaattcaaagaatggcagggcatctcacctctgcagggggcacccagtctggctgggcaaatggccccacattaggtatgacgtgtggttcactggacagtcggcttcggagaacaagctccctggggcttaactggaccacagttctcacttccatgctggggaaaccgagcctcagcgaggttcaaggacacaccaaggccagcaggaggtgtgtgctttcttaacttctgccctcgctgaccagtcaagggctcctaggagcctgtgaggtggggaaggaacaaggggcctctgactttattcttttatatacactaactctactctatcatttctttatgagatatcatttggtaatatgagacaatttactctcaaaaataaccccaataccatctgtacagtatacctaaaggtctgcttagacaagacagaatatagtccagcatgtgggttgggacattaaaaaaaaaaaaaaaagcagactgagccccaaagaaggcaattgcaaattctgataatatgacttgaaatattatctttgcactggctttgaacttcagcctcccctgaggatactatagtaattcgatagcagccatcacaagaattagaagctgacaggcagagaaaattgttatggattccacagtctttgaatctccaggcaaggctgtgtggagaacaggttaatggctgtgactctctcccgggggacgccaggtcttaaatccacatcagtagatgggttcgctctgggcgcacaaatgctggaaaaaaaaaaatgagacgtaaatactaagtcagattaagggaggtaaccaaaggctatgaggatttgagaagagaagaaacgtaccgaaagtgaaggatggattaataatgggtaaactggtaaattctttaactgattccttggatatacaaatctaaatgcaaataccaaaaggagtcagggagttagagtcactgggccctctgtttccttggttgtgtctacgtaaggccacaggtatcccagttatttccagaaatgctgggttttgtctgcgggccgtggaggagggcgctctgggtgtggctgccccctggtggacgccttgagaatttctcaacgcaccgggatccctgagcgccgggagccaggttgggggccagcttggggcccgctgaggtcctccaggtgggcttttagacatctgcaggaagctagatgtccactcacttgtcaagtccagcgggacgggcccaccgtggtcattactatgaaacaagagggagagagacagaagccagcctctggaagggctttccgagcaggggcctggggacccagaatcctgagaagccgctaagacccacttctcccttccttggcgctagaacttcacccacgcctcctctcccacaatcacatcacgtcttttccagccctttggaaccacctctcatccagacctaaggccttttaatggtccaggcctgtggccgctggtcttcgataaagatgcagcgcaaatgtgggtgccagtcacccaggtgactggttcagaaactctcacggtgggggagggggacggggaaagtggctgcttgtctaggaccccgcactgctcgcccaccccgctaccctcgctgggcattatcctctcactcccgacagtccccagaagcagctcctctcagagtacaaactgggagggagtgcgaggaggccgggtctgggggctgggctcaccccggggcggggcagggggcttcccccaggatgagaagagctctggggtaacctggcgatgaaagaccttaaggaagcatgaagaatggagaatgtggcttctttggggacaagccaggagatccataggaaggaacccaggtctcctgactgatttttaaaactttgttgttgttcagtcactccgtcgtgtccaactctttgcgaccccatggacggcagcatgccaggcttccctgtccttcactagctcccggagttcactcaaactcatgtccaaacggtcaaacttgtgtcaatgatgccatccaaccttctcatcctctgtcgtccccttctcctcctgccctcaatctttccccacatcagggccttttccaattagacagttgtttgcaaattaattaattttttatgtttttgtctgcactgcaaagcatgcaggaccttagtcccctgaccagggactgaacccacagcccctgcagtagaagcacagagtcttagccactggacagccaggggagtccccctcactgctttttaaagatagcttttctgggagaattcagggaaccatcatgtaacttcctgtggctgccgtgaacaatggccacagaattgcatcttgaaacaacataaatgtatcccctcatggttctagagtccagaatccaaaatctggtgttggcagggccctgctccctctgaggctcttggggaggaccgttcctgcctcctgcagttctggtgcgtccttggcttgtggtcacaccactccagcctctgtctctctctcacttggccttctgctctgtgtgtacccacccctcttcctataaggacaccaccttcttccaagatgatctcatttagttccttaccttaattacacctgtaatgacccgattgcaaaataagggcatattttgagattctgggtagacatgcattttactcaatccactgtagtgattctgggcttccctggtggctcagatggtaaagaatctgcctgcaatgcaggagattcaggtttgacccctaggtcgggtagatcccctggagaagggaatggctacccattcttgcctggagaatcccatggacagaagagcctggtgagctacagtccgtggggtcgaaaacagtcagacacgactgagcgactaacactttcactttgcactttcacagtgattcgaggccatgggtgtagacagtgcctgctgctgctgctgcagctaagtcgcttcagttgtgtccgactctgtgcgaccccatagacggcagccctaggacataaaaaactctcagcatgtgtcagtatcacctgttttcaccagctgaaaggtgctactataaacccaggtgtgatttttgtccagtgatgttatcactgcatattttccttcctccaccatgggccttatcacttatttgtgtctgatcagtcagggtccaatcaggaaaagagaaaccctactgtttgttttggcagagaaattaatgggaagaagtggttaagcaggtgtggaagaactgaaaaaggtgaaaatgggaaaagagactgagaaaacaaggaggtattaacagcacgcagcagccagcaaccagaaagagtaccctgtctcttcttggaaggcgattgccctgtcaatcctcacacaggctgcctgacacagggaattggagggaagattgattatttggtgctaaaatgtaaactgacccatggggactgctgctgctgctgctgctaagtggcttcaatcacgtccaactctgtgtgaccccacagacggcagcccaccaggctcccccgtctccgggattctccaggcaagaacactggagtgggttgccatttccttctccaatgcatgaaagtgaaaagtgcaagtgaagtcgctcagttgtgtctgactcttcgcgaccccatggactgcagcctagcaggctcctccatccatgggattttccaggcaagagtactggagtggggtgccattgccttctccacatggggactattccttggatgtcagaggctccatgctggatatatactaggtgaaacttcttgcctgctttactaaagtaaatggtggcccttctgatatttgtggacaaaaggaaaaaaaaaagaaaagaaaactccaaagtttcagctgttaaacaaccccttcagagctggcaggactgaccccctccctgttagggatgtgtgaattcaaggagcagctaaggacacacacacagtgactgttgaattatgcacttcacaatttttttgagtgcttttgtacacgtcatgtgtaaaattcacatatctaaccattgttctagaaagcatggagcaggccccacagtgagcagggctgtctcatcagtggcctctgttgaaaaccctcgggcctgccacccagagaatcctttttggacggtgggcttccctggtggctcagaggttaaagcgtctgccagcaatgcaggagacctaggttcaatccctgggttgagaagattccctggagaaggaaatggtaacccactccagtattcttgcctggagaatcctgtggatggaggggcctggtgggttacaatccacggggtcacaaagagtcggacatgactgagtgacttcactttcactttgcggggatggtctggttgctatagcagcctctcagcacaaggtggcagagcatccatgggtaccctggagccctggcccgcaagaacccctgagtccagagtcctcaggggcctcctggagtgcccttggagagagctggcggtggtcaggtcaggagagctgacactgaactactgaatcagcagttactgacggtgccgagtcagagggagaatgaattactgcatttcaaagggcctttgcaataaagtcagggcaacctgacttttcatccctcttctgagtctccctcccgtgaggcaggctgtttctcttacacagtgggatgtttctacaagaagatggaaatcaagggcatagatggacgtctagggcattcgattttaaaatgtttgaaggctagtatttcaaacatctttagcacagaaatggctgcttccctgtaacgagttaatatgttcactgaaaattctccactcttaaaaaatggatttgcctttttaatcggtaatagaaacatagtgaaaaaaaaaaaaagtattttaaaaagaaactgcctagaggacaataccaggattcttaggtcttttcagaaatattctttgcatatacaagaatatccagcttttatatacaaatggtgaacagcatgccaatcagcctcttgcttattttcttcctacatatcaagatgtttcatatacaaacatctgcctcattccttgactaggatcccccattgtgtggatttccataccatcttttttttaagtttatttttaattgggggaaaattgctttacagtattgcattggtttttgctgtacgacaacgcagcccataccatttttacccctcctctcttgatggacatttagatgggtcccagtctcttgcttgcaatgaccagacctgcacatatgtcctggaaatactctcaaatcacacctaagtcccccgaactttctggaagataactgagtggtcagaagtttataaaattttgtatttatattttataaaatttacgtcataaaatgtgaatagcaccctttatcctcaataatgatagtaataataactgacttctatgatctgtcactgggagtcagacaccattcagacggttttgtatactgtagtgaacacactgtggatagacccactttacaagtggtttttactctcctgtgtgctaagttgcttcagttatgtccaactctttgcaacactatgagctgccaggctcccttgtccatgggattctcaaggcaagaatactggagtgggttaccatgccctcctccaagggatcttcctgatccagaggttgaacctgcatctcttacatctcctggcattggcagccaggttctttaccaccagcaacccctgggaagccctttcctcttctactagaggtaaatgagatcactttataatttgaatttgcatcgatattattataagtaagaacgagtatattttttctactaagtcatttgcatttgtttttctttgtatatttttaaatcttttttttttgtatttctttttctgtgaatagctgtctgtgtcctttgaccatctttctgttgaactgttgacctctgtttttaatgttagaaaccttttaaatgttaagaagcttgatatattaccttgtatgttgctaatgcttcccccaagtttatcatttacttttttgtcttgacttggttgatagtattttttttttagccacaaagaaattttcagttcttatgtagttggatttatcggtcttttcttttgtgaattttgacttttgtgtcatgtttggaaagattgtcacaatctgggattacaaaaataaatctcccatgtttgttccagctcttttatagctttatttttaaaaatcataatttaactccatctggaatttattttggtatactaaagtagagatccaattttactctttcccagatgtttacccagttatcccaagcatttatgagataactgatctcttctccactggtctgaaacttcctctctattttatactcttttcctgaaagtttttgagtctgtttctggaatttcttctattcctcttagaatcaagcacttttaatttctgtggttttacaatttgttttgttttcccaggtagcagatgtggtaaagaacacgcctgcaatgcaggagacatatgacgtgtgggtttgatccctgggtcaggaagattccctggagaagggcctggcaacccactccagtgttcttgcctggagaatcccatggacggaggagcctggcgggctatagtccatggcgtcacaaagagttggacacgactgaagggacttagcttgcaagcccacaatatgctttaacatattgcagggatgtttcattactttttttccactagaaaattcttggctatgctagcatgctcaattttctgtataaaatttagccttaacttatctgtgtgaatttgaatgtagcaagcctctcaaagtctttgtttacataagaaatttagtggatttgtttatcttatgcttcaggtggaagaagaggaaatccaaacaaagaaagataacaatgcttatagtgacacttttgaggaaacagttatccatttttatctttgccagtgtcgacataagttaagtaaaatgaccagcttgaattatagcctttcggaaatcgagtttacttttctcagggcacagaggcagctttgggaatacaggtgattcgtctgttcctttgttgcaatgatccctgcaaggatgtgtgttgaggatgagggatgctctctgctgttctctccagctgcaggggaagaaggactgtttgctcctttagattttgctgagattttgctgtgattttttttcaggccaaaaagctgaaattccattcattgacgctgaaaaaaatgatgggcctgaaaacatgaaatatatcattggaaaagaaaagagaagaaaaagatcattaacaaaggaagtagggctctgaaaacttggcattcagtttagttctggaaaacaaaacaagaacaacaaaaccccagaaatgtccattgatattttgctgggattatactaaatctacagaagagtcgactcattagaaaagaccctgatgctgggaaagattgaaggcatgaagagaaggggatgacagaggatgagatggttgactggcatcaccgactcgatggacatgagtttgagcaaactccaggaggtagtgaaggacagggaagtctgacatgctgcagttcatggagtcgccaagagtcagacaccacttagtgactgaacaacaaaaacaacagacgaattagaaaagaattgtcatctttgcacgtcagtctttctaaggataagcagtatttgcatttagtcaaatcttcctttttgtctttcttttcaaagattttgtctgtatgaatcttccacattcattctattcatgggtgttttatcttttttgattccaattgtaagtagaatattttcttctgttatatttacaaagttactgctgttaacataaactctcagatattgactattttagaatttatctcatgcccactcaacttattgaattatcctcctgtttctaacagctttgcaattgattctttttatttttccaatcatacaatcaatgataattttttgtcttttcttttccacttttagtacctcttatctaattgaattgaataattcttccagcataatattaaatgacagtggtgataatgggtgattggaaaggagtacatcaaggctgtatattgtcaccttgcttatttaacttacatgcagagtgtgtgtgtgttagtatctcagtcgtgtccgactgtttgtccacaactgtttgtgggccatagactgtggcccacagtgctcttctgtccatgggattctccaggcaagaatattggagtgggttgccattcccttctccaagggatcttccagacccagggattgaacccaggtctcctgcattgcaggcagactatatatgcagagtacatcatttgaaatgccaagctggatgaagcacaagctggaatcaaaattgtcaggagaaatatcaataaccccagatatgcagatgacaccacccttatggcagaaagcgaagaggaactaaagagcctcttgatgaaaatgaaagatgagagtgagaaagctggcttaaaactcaacattcaaaaaacaaagaccatggcgtctggtcccatcacttcacggcaaatagatggggaaacaatggaaacagtggcggacgttatcttttgggctccaaaatcactgccgatggtgactgcagccatgaaatcaaaagacacttgctccttggaagaaaagctatgaccaacctcagcagcatattaaaaaaccatgagcgagctgtcggcaagcagcctgcttcacccggactctggtgaagaagtaacctggaaagtgaaattgctcctttcagtgcttggggtgaagcagtgtattcacgctccgtaacttcagtcgtgttgcactctttgtagccctacggactgtagcctgccaggctcctctgtccatggggattctccagctgagtcagtgtgttatgatgccgtctcacaccaacctggctactggaattcccagtagcaaagtgaaatactcaagactctcttgtacagatgatggctacattgaccttcagtttaagaaaagcccgccaaagatcccatataaggccattgcgcttacaacagtgctgtttttcattggtgcctttctcattattataggctccctcctgctggcagggtgtatcggcaaagagggagcagaccgggcctttcctgtcctgatcattggcatcctggtgttcctgccaggattttacccctgctactggggatactcctgcaatgatgttccagactttgatgactagcattcaccccagccctgaagaaaagagtcacagatggaactgagcccagctttaagacattgagcagaaactatgactaagggctaaggagttctccagtttgcagatgtttaatgaaacagtggccagattttatgggtccatcctaaaagatgttaactaagctcacaagtaattgtcattagggcattctctatttttaatttcttggccctggaaaaatctcctgacaagtttttccatatgaatatgccagatttcttattactaagtaatttattttgaaaatatctaagtgtcttatctccatattctaactttgtgttctagtggaagaccttggcacaatcaaatatagtgtggtgcatctataatatttcctacttgctttcttataacaacaaccaggaattttttaaacctcagagcaaattttcaaaatgtagacacttttctctgttcaccaatccttggccagctctgatgtggctcactgataggttggccagcatataatttggatcattttgtcctgtgtagatcaagaagttctatatatcatacctttacggactagacttttagctgtttcctaaagaaaaaataagcagagacattactttgccaacaaaggttcgtctagtcaaggctaggtttttcctgtggtcatgtatagatgtgagagttggactgtgaagaaggctgagcaccgaagaattgatgcttttgaactgtggtgttggagaagactcttgagagtcccttggactgatccaaccagtccattctgaaggagatcagccctgggatttctttggaaggaatgatgctaaagctgaaactccagtactttggccacctcatgcgaggagttgactcattggaaaagactctgatgctgggagggattgggggcaagaggagaaggggacgccagaggatgagatggctggatggcatcactgactcaatggatgtgagtctgagtgaactctgggagttggtgatggacagggaggcctggcgtgctgcaattcatggggttgtgaagagtcggacatgactgagcgactgatctgatctgaaggaaaaaatgtagatgaatggttattatttagagtttataaccctattttagcaccttgttttatgatgtaattctgctgaagattttaagaattgacctggatctctggaggactggactgccttagcttgatctgccttctagcttgcaaaaagtgacttgtattcaaaagaagttaaaatgtcaaaatctaaaaaaaaaaagcagagattactttactgacaaaggtctctatagtcaaagctatgttttttccagtagtcatgaatagatgtaagaattggaccataaagaaagctgagcactgaagaattgatgcttttgaactgtggtggtggagaagattcttgagagtcccttggtctgcaaggagatacaactagtccatcctaaaggaaatcagtcctgaatattcattggaaggaatgatgctgaagctgatgctacaatactttggccatctgatgtgaagaactgactcattggaaaagaccctactgctaggaaagactgaaggcaggaggaggggacaacagaggttgagatgtttggatggcatcactgactcaatggacatgcatttgagcaagctcctggagtttgtgatggacagggaggcctggcatcctgcagcccacagagtcacaaagacttggacatgactgagtgactgaacttatgtctttttctcctttcagttttattcaggtataattgatgtattatgtaagtttcaggtgtacagtgtaataattaaactgacatcataaaatcatcatgggcttcccgatagctcagttggtaaagaatccgcctgcaatgcaggagaccctggttcaattcctgtgttgggaaaatcccctggagaagggataggctacccactccagtattcttgggcttcccttgtggctcagctggtaaagaatccacctacaatgcaggagacctgggtttgatccctgggttgggaagatcccctggagaagggaaaggctacccactccagtattctgcctggagaattccatggactgcatagtccatggggttgcaaagagttggacacgaatgagcaaatttcactcacatcatgacatgattaccacagtaagtttagggaacatccatcatgttatataaattcaaaataaaagaaaaaaatttttccttgtgatggaaactcttaggatttactctaaactttcatatgcaacatattaaagtgtcggtgtttattgtatttatcacagtgcacattgcattcacagtacttacttaccttacaactgtacttttgtacctcttgactgtcttcatccattttgccttcccccccacctctggtaatcacaaatctgatctctttttctgaatttgttcttgaagcataattggcctgtgactagtttagttcctgatccagaaaatagtgatttaatttctctatatttcaaaatgatcaccatgataagtttagctgcaatctatcaccgtacaaagctgttatgtattattgcctctattccccacactgtggttttcatacccatgacttgcttattttgtaattggaagtttgtacctcgtaatcttctgtccacaattccctcatctccgtatccccctcccctctggaaaacacttgtctgtcctctgtatctatgactctggttctgttttattatgtttgttcatttgttttgtttcctagattctgcatctaatcaaatcatacagttttttctttctctgacttcttttacttagaataataccctccaagtctgtctattttgtcacaaaaatagaaagatttcatcccttttatggcacaaatatactcctctgtgtgtgtatgtgatcacatcttctttatccactcatcagttagtgtgcacttaggtggcctccatatcttggcagttgtaaacagtgctacagtgaacacacaagtgcatatatctttcaaattagtgttttcattttctttggataaatctccagtggaattgctggattgttcagttcagtcactcagtcgtgtccgactcttcgtgaccccatggactgcagcacgccaggcctccctgtccatcaccaactcccggagcttactcaaattcatgtccattgagtcggtgatgccatccagccatctcatcctctgtcgtccccttctcctcctgccttcagtctttcccagcatcagggtcttttccaaagagtcagctcttcgcatcaggtggccaagtatcctgtggccaaatccagtggaattgctggattgtatggtaattttttgaggaacctccatactgttttccacagcggctgcaccaaattaattcccatcaacagttcacaaaggtttccttttctccacatcctcaccaacacttattggtaaatttatacaattctgtgcattgcattcaatacaaatgatatgaacagggatatttctgcctttacatttgcattttctttgtgtgtctatgcccattctttgtctttggatataattaagtgatttagattagttaataactggaagctggctgcgaacatgcctagcatgtagcaagtgccaattgtttgccaaaaataaaaaataaaaacaaagcccttttgtatctctgaataggaatataattggctattgtttgtgttgattcttttttttctatgtgcaatatatagataggacaagaatatttagtcttggtttattatctggttttagatcatgcttttttgttgttaatgttttttctttttttttcttttatttttaaactttacataattgtattagttttgccaaatatcaaaatgaatccgccataggtatacatatgttccccatcctgaaccctcctccctcctccctccccataccatccctctgggtcgttttttcatttttttaaaaatttgtcctattttcttctttaattcttctctgtgagctctaatgcagggtggggcttgatttccccgccctgtattcaggttggggaaacagtcttgattcagtaattacgatgtgcagtctcatgtcataatcaaaattctgagctcgctctcaggttggggctcccccagctccagctcaggctgcaggcgcaggagaactgcggtgggaaagtggggcggccttcttccccccatcacatctcttccgcttctcttctcggcttgtgacggtggcgtctgacctcagcaggcctgaagctaaggaacaagagtgggagcagaggagagcagtcttaagtgtcagttttccggtgtgggatttggagcatgacagatcatttttctgctgcagcgtgtgaactcttccctggagaagaaaatggaaacccactccagtattcttgcctggagaatcccatggacagaggagcctggtgggctcctggggtcataaagagtgggacacgactgaagtgacttagtacatgtgaactcttagttggggcatgtagattctatcacagtttccctgaccagggatcaaacccaggcccccttgcattctgagcccaaggtcttagccattggagcaccaggaaatcccttgggttcattttttttttgtctttgaagatttgctcatggtcttctataactatgccaggactgtgttcaacagcggcgccatgtggcagctggaggcaacagcagcagaggttgtttccgggtcctctgggcttggtggaggaagtcaggctgccctctccctactctggacaaagttcctgggactcctggtcaacctgggaggccttaagcgggaaagaaatatgggagttgctgtgaaccaagcagttgaggactgaaggaattaactgggagaagatgagatgggactgtatttgccccttggagtccctcatggcatcacaatttatcatcctttgtttacaaccgaggttcagggcaatgaagtaacttgcctggagtccctcagttagtaagtgacaaagccccaggtagaaccagggtcctccaattccgaaggctttgagctcatctctgcatctccctggacacagcagtgacctccatgctagaagacaccagtgaagatgaaaggaaatgcaggagtgacctatacattcaagattttttagaaacacgcaaaacatctttttaaaattctctgggaggctgtaccccctgaaaaggcagacacgtctggaatctgtgttcttggccattgaactcaggcatcagttttaatgttctctggcggtgctggatgtcagaactggttggtgggctcttctttacaccctcagaaaatactcctcagaaagaaggtcaagtgtggatatgggtgtttatttaatgacacttttaaattctccttctggtcccctgaaatgcaaaagcattggtttgttttctttttattttggagagtcaaatacatgtcaccgccaccttggctcccaatttagccatcctctgatctgacgggttctgtgagggacaaaaataaaaagtcatggcccactgagagttcaaattctaatgtcaaaagagctagaggtaccggggtccttctccccagatctgtagctcagataaacatttactgggtgagtggtttcacttgattgccttgaggtcagtattcagctagactgaaccagaaggccagaggagacagacccaagagggaaggaaattcttggcccacgttggggtacgttttgctgttatgtaagcatttgggaatgacaaacactgcccagaccctgtgaccgtgatcttgaccaccccctgcccccaggcacagggcactttttccttagatggtatcatgtgcccatagccataatggaatatagaaccctttttaaaaaacagcatttgcatttttctaggtaaaccttcaaaactttcaactttattttcccatcaactttattttcccatcgcctataaaggctttccatgttaaacagtaaggtgaggtttgcaatgaagtataacaaacatggacatgaatttgagcaaactccgggagatgatgacggacagggaagcctggcgtgctgcagtccatggggttgcaaagaggtggacacgactgagtgactgaacaacaacaatataacatacatactgaaaagtgaactcagttctaggaagtgtcccaaatcgaataaacccctgaaaccaggacatggccagcactttagagctccctttctgccccctctagtcacctttactgaaggatatacattaccttgacttttaacatcatagtttaatttcagctaactatgggagggcttcaaggtcatggttatatctcagcagggaccatctacaattcaacctatacggcaagcaatcaggagaattcttgggactctgggtccagcttgaaggtgggattcagggtgtggaaggagattcctttggtgccagactacccacctctggcactcaggagctgtgtaacatcaggcaggtctcttctctgagcccctttaaatgaggatggtactcctgcctctcatgggttctaagagggggactcaggaggaaagtgcatgttgttccgttgctcaatcctgtccagttctttgcaaccccatggaccgcagcacgccaggcctccctgtccttcactatctcccagagtttgttcaaactcatgtccgtcgagttgttgatgccatccaaccatctcatcctctgctgtccccttctcctcttgccttcaatctttcctagcatcagggtcttttccaatgagttgcctggcacagagctgtttcctaatgtaagtgccccttgatggcatggatgagaccaaagcccccctttccttgcacctcccctatttttccggagttcatttcttcccacatcccatgccgacatcctgccaaaacttctgacttcccagctgatgcacgctcccaagcctccacctcttgggctccaggggcctgggatgtgtcctccctgtcctggggcagccggtgctggcagccttcctgttcagacacctccaggaggagtagctcttccctatgccctgggcttcctcgctgtctccctgggatcagaggttattgatcctgctgattctgcaccttgcaggtgagtaatctacagggtgggtggggacttgcccagggttacacaagggtgcatcgggaaccagagcactgacttacatccctcgtcactgccattagcccttgatcatgaaggatctccagccccttctcacctctcatggtcggtgttaaaaaccccgaactctggggcaaagttggaggtgccagggtccaggcatcccacagccaggacagcaagagcagaactttgaccaagatttacatgaactgaaatgaaagtcgctcagtcgtgtccgactctttgtgaccccatggactgtatagtccatgggattctccaggccagaatgactggagtgggtagccgttcccttctccaggcgatcttcccaacccagggatcgaacccagggtctcccgcatcacaggtggattctttaccagctgagccaccagggaagcccaagaatactggactgggtagcccatccgttctccagcggatcttcctggcccaggaattgaactggagtctccctcattgcaggtggattcttttaccaactgagctatgagggaagcctcagatttacatgaatgggtgtgtttaacacagttggaaagtgcgtgtgtgtgcttagtcattcagttgtgtccaactctttgtgaccccatggactgcagcctgccaggctcctttgttcatggaattctccaggcaagaaacactgaagtaggttgccatgggctcttcctggcccagggatcaaacccgagtctccttcattggcaggattctttaccacttgtgccccctgaacttctttatattcataaggaatatatagtaagaattcttcttcccaacctgccctccctctagccagttctcagctccgcaatttcctcctgctcttactttctcaggcatccttaaaggggctcttcaatgcccatatgaacaacaacaaaaaaactgcatgatttttcctcctactttgttacataggtggtaacatactcccttcttggctgttctcattcagcaaagcatcttggagtgcttcagcttcccagggactcagtggtttaaaaaaaaaaaaaaatctgcctgcaaatgcaggagatgcaggagatgcaggtttgattcctgggccaggaagatcccctggaggaggaaatggcaacccactccagtattcttgcctggagaatcccttggacagaggagcctggcgggctacagtccgtgggcatctcaaagagtcagatatgacttagtgactcaacaacaacaacacaaatagcttcctcattctgtttcacagatgcatagtattccattgtttacctatattatagtattaaaatgcaattcatatcccacaaaattcactcacttaaagtccagggttcagtggattttagtatgtttacatattttcacaaatatcaccacaatcaactataaaacacttttatcacccccaaataagctatcccttaattatcatgccccagtcccctacatcggagaaggcgatggcaccccactccagtactcttgcctggaaaatcccatggacggcagagcctggtgggctgcagtccatggggtcgcaaagagtcggacatgactgagcgacttccctttcacttttcactttcatgcattggagaaggaaatggcaacccactccattgttcttgcctggagaatcccagggacgggggagcctggtgggctgctgtctatggggtctcacagagtcggacacgactgaagcgacttagcagcagcagcagcagtcccctacatcaacccaaggcaaccactaatctactttcttcctttgtagatttgcctgttcttgacatttcagatgcacagagttgtatgacccgtcctttgtagctgttttccttcatttggcatggtgctttcacggttcgttgctgttgcagcatgtgtcagtacttcgttcctttttattgccaaataatatttcatggcacagatagatcacattttatttttctgttcaccagttggacatttggacagtttccactttttagctattttgagtcatgttgctttgtgcatccatatgcaagttttttttttgtctggatgtacatttatgtttatcctgaatatacacctagaagtggaattgctgggttctatggcttatttctggggaaggaaatggcaacccactccagcattcttgcctggaggacccatggacggaggagcctggtgggctacagtccgcagggtcgcaaagagtcggacacgactgagcgacttcatttcatggcttatttctaaactgacttatctagtcccctattgatgaaaatatgataaaattacatcttaaaagccagcgagcctcatgaattaggcaggtcagggccacgttagtgaggattcaggaacagtggcagcatcagagaacctgcccaagtcttttaacctttcctcctggtgttcctatttctcctagacacttctcctcttttccagttaactttaatttcaaagtggtccatgactcaggggtgtgggaaagagcagccccattcctcatggcctggctcatgagtccatcacccactgatcctgagggaaccccggctctcagctgtgtcctcctgcacagactcattcctgtctgggtttctgcatccaggacagtccaagaggaagctggtgacttcctctggcccttgatagtgggtctccgccacacctggccatgagcatactggctacaggtgcagaacagggaatttcaggaaccatccaggctctaagccagcctcggagagcttcctgcccccgcagccccagatgggacctgcaggagccgccgtgtccttggtactagggtgcgtctaaacagatcttctcaacaggccaacagcaggaggtgctttttattctgtgccgatagaagacagatcaacttttgattctctgattcatcgaatgagacaaaatgagtccagtttctctctgctaaacttctattagatgctgccctaagagtcttcggatatcaagttactctctgctcttgaaacctcagtgttgacttcagaaagactgtgatcatttgcaaaaagaagttgccctctttccatggcagatgtttaaacttgcctccctaagggtcaagaaaaacaccacctcatggaatgtgagtattctgctccaacacaaggatgagcagttctaggatttcttacatgtttcacattattgatgaaaagcttggtctcttctacaggatatagaagataccatctaatttattcttctctatttttttaaaaggtaaagaacaatgtactgccttaattaatatagtgaaaatctttcatgtgacaaatggactggttttcaaataattttatgctctgttgttcttggctttgttttatatatatttgaacatagcacgtcattctgcaacaattcacagaaaggtctatgagtttatccatgtattccaagtttaagcaagttctcttactctaattaaagtttatgatgttcttgttgagttgatttgtttttaataattatgggaacatttttgtcttccttatttaagttctcaaaccatgttatcaacagcagtaggaaaattcctgatcactgtactgtttcttatgagtgaccaattttatataatgaaatttgttaattgggactttgtcacatgtggtttgcacagttatttttaaatgttctccctaatctcaaagtaataagatcattcattcattcaacagttaattataataaaaaaaaaaatactggtctccctgagctttgcattagcaaaatgaattaacaagcagatatgaaatagaaaacacttaatgcagcgcctttggggtcctcagcagatgatgggatttatcctatgacatgtctggacacatctatatgcacatagagcaagaaatgagaatgtgaacctataaagctcagctggaaaatgtctcacaggattaggtactacttctctgactttatcattgcattttcaccagctctcctagtagagaaaaccgttttgaggtaaacagcaattaagatcttaatcttctggccttagaagggcacacagtgtcctcacccaggggcacttcaccaaggagaccagaaaagtgcccacttgcacgcttccattttttaattaatttctttttgaaaataaatacccatggtacaaaatgtacaaaagggcttcggtgaaatgtatacctccttcccccagttctcctccccatgggcaaccctagacaccaattccttctgtattctcccagtggtattttaaatatgctcaagtttcaagcaaatagcacagcccactttatatataggattttttttcatttgttatgatttagcacaagaaagctctttgttacttttttttttggctgcattgtatcccactgcatggaatttccaagatggattaaaccatctccaagttgactctattcaggctgttcttaaacgttagtcatcacaagagtgctacaaggactaatcgtaaatatacatcgttttggacttgttctggcatatttttaggataaatttttacaggtagaatcaccgggtcaaaggtaaacgtgttactaatgtcaatgctaagtcgcttcaatcgtgtccgactctgcgaccccatagacggcagcccaccaggctcccccgtccctgggattctccaggcaagaacactggagtgggttgccatttccttccccagtgcataaaagtgaaaaatgaaagtgaagtcgctcagtcatgtccgactcttagcgaccccatggactgcagcccaccagggtcctccatctatgggatgttccaggcaagagtgctggagtggggtgccatcgccttctccaactaatatcaacagatcttgtcaatgtgccctccatattggctgtgtaaatttacactctcaccagtcattaagcaaaagcctgacagccccatggacatatctagactgtcttctgagacatcatgaatttgcaaacctgataaataacaaaatattaccttgctgtagttttaatttgcatttctcctattatgagtgttactgagaagcttttcttatgttcaaggtccatttcttttcctgaactaattgtccatatcctttgcatagttttgtactgaggttttgtactttttctgatagaactgaagcttatgaagaagttcactggcgtaagtatctattttttctagtttgtcatttgtcttttgtatgccatcatttaaatttttttgtgtaattggagttaacattttctttctcctttttttccacctctgaatttttgtgttatgcttagaaagggatgtcccactctgagatgataagcttagtgctcagtcgtgtccgactcttgcgaccccatgagctgtcatgtgaacaggctcctctgtccatgggattcttcacgcaagagtactggagtgggctgccatctccttctccagggggacttccctaactaggaattgaacccaggtctcccacgctctgggcatatgctttaccaactgagctacataggaagccctcaagagatgataagggggaaaaatctaccatgttattttctagtattaaaattgtttttattattaaaacttttaaactatttttaatattaaatttttaaaatattaaaatctttcatttatctggactgttttgggtgagagagatgaggtgagagatgtagattcattattatcttgttttaatgctatttattgaaaactccatcttttctctcctgatcacaaatgcccctttatctaccaaattccgattcctactctactgatgttttactctgtttggtctgccagtctatgtatcttgtcgcactgtttgagttattgtagttttacagggaagacttttcaaggaaaagttgcacctggtttggaagagcccctcatgccctttgcaaagcccagtaagccccagctggactgtgggcaaataaagcactcgttcgttcaaaaaaacagtaaacttatttttctggctagctagttttagatttcttgctagactaatttccactcatttcaactcttcctttcagaggtctcctaattagtcttgacagttgctttttcagtatgcatagcttgtttatttcacaaagaaatcctattgatgtttttattgcaatcatgttaatttgtatagattatcttagggaaaatggatatcgttatgatgttgtgtctcctcttcaagaacttgatgttctgaactctaaacaatgatacagatcagcctatttgcagggcaggaatagagatgcagacacagagaacagacatgcagacacagtgggcaaaggagagggtggggagaactgggagattcggattgacatacatacacactgctgctgctgctgctgctaagtcacttcagtcgtgtccgactctgtgcaaccccatagacagaagcccaccaggctcctccgtccctgggattctccaggcaagaacactggagtggattgccattttcttctccaatgcatgaaagtgaaaagtgaaaagtgaaagtgaagtcgctcagttgtgcccgactcgtagcaaccccatggactacagcccaccaggctcctccatccctggaattttccaggcaagagtactggagtggggtgccactgccttctccatacatacacgtactggagtggggtgccattttcttctccatacatacacactactatgtgtaaaatagtgaatacagtaaaatagtgctgtggtccgtggcgtcgcagagtcagacacgactgagcaactgaactgaactgagtgagaagacgctgtatagcacagggagctcagctcagtctctgtgatgacctagagacatggatggcaggggtgggaggcaggttcaagaggaaggggatgtaggtatgcatacagctgattcgcttcattgtacagcagaaatgaacacagtgttgtaaagcaatgatgctccaattaaaaaaaatttaaaatatattgacatgtgtgttgtgaggcttctacctattgagcagaaaaagcctctttcagcagtcccatttccccactgacatgaacacactgccactggcttggccaggcagccttcagcccagaatgtgggtctcacacaaacatctctgtttctcagggcattgggccaaccagacccaagccagccgcatcctggggcacctgctgggggaccacatggagggaagaaacagcagcaattccaccagggccctgaagctttcagatgggaccagagccgcttggtatatcctcaccatctttggcatctatgggctgattttcctcttccgattggccagcaacatcctcagaaagaatgaaaagtccttggaagacatttattactccaatctgacatttgaacttgaaaagaaagggctccagagcaaggcagccagatgctcttcactgaccattagccacagagctgtcctgcggcccaaccaggccagcccagagacaaagggtgggaacagcagcccccacgctgaaatccaagagatcccttgaaagtcgaggcaaggaggcctctacagctgaggttcaaacttcttgcttgagggagcagctttgggcttacctggaaccttgggaggtgagtcgagcccttgagcggggccgcaggtgcatgggggtgggcccaaaagccagcatcctgtttccttctcaggcttcctgatgctctgagatgagcaggagtagcagctttcagccctactcacccttcactggaaaactttatgctccagacaaggacatgggacatccactgttctcaaaggaatctggtaggctcctggggcatgtgtgaaggtagcctcttgtcatacaaagaaggctgaatttggagtcaaatgccttggatgaaattcaacttctagagggtcatatgagcctgactggctggtggctcacgtggaacatgtgagggttgggatatatggtctcaaagggccattcattctaaaactctgtctaaaatatcgaaccaaaatagtcaatatcaacatcctaattttcagaagttcttcattttcattgagagtgcaggatccattttaaaaaaatgtattagttttggagtcagaagaatcagaccctactctgagttagactcttgaccactttgatgtccttgcacacaccactcacctctcccaaccttagtttccttacagataatgaggataacgatgccagttttctgccaaccttgcaaagcagatgagagctcatgaaatcatgtatatgaacgtattttgaaaagtaaaataaatatgcaaatataaacctcattgtggtggtggtgatgatggtggctgatgttaaattatggtgatggtagtattggcggtgttaatgattgtggggttggtggtggttgatggtcagggttgatggtggtcttggtggttgacagttgagttgatgatggtgatggtggtggtgactgatgttgttattgatggcatcggtggtggttgatggtcagtgttgacggtggtcttggttgtttatgttgatgatggtggtcgtgggggttgttgatggtgttggtgttggtagttggtgttgatggtgttgttggtggttgatagtgttgatggtggtcttggtggttgatgttgatgatggtggtggtggtggtggttgttgatggtgttgttggtaggggttggtgctgttgttgatggtggtggtggtagtggtgatgctacctactgtggtccaggaaatgactagcctactggtaatagctgtaagtaatggctgcattacttgattctaaaggagaacccatctgcatcaaagttgatgatgtgtgctctaaatcaagtccatgagattcaagttgtacacgtagacaaaatagtcacttttagttttcattactgtagatatcatatgattcattcaaatgtttcacaaacatctgtaacttatattcttgtctctgcttcaaaaagaaataagatcttgcctacatgactgattcatttagagagattgtgattagctgaatttctacaagtggctttcagtaggcagagagaaaaagtatgttttgtaccaacctctgtgaagtttatctggctgggcttttggatgggtcccctgaacaacaaataaaaaaattttcccctgtctatgcgcagtggtctataattaactgcatgatttcataaaggttaaattaaatgccatgctttttttttttaaaggatgagatagacttccaactatttttctttttttcatattttccacatgatcatcttacaggctctccagcaaaagtgtttgttggtttgtttatatagttaggtctgggcatcacccacgtttgagactcttacggggcaggataaaacagtagacacaaagacagacaaaaatgtaatccacagtgaataggaatgtgtgtgtgtacagtcgtttccatcatgtctgactctgtgtgaccccatggactgtagcctgccaggctcctctgtccatgggattctccaaatcaagaatactggagtgggttgccctgtcctcctccaggggatcttcccaacccaggggtcagatccatggcatctcctgtgtcttctacatcacaggtagattctttaccactgagctacccgggaagctcgaataggaatgcagaatgcactaaaatgggagcacaaggtcagaactgaagtgaatttgaagataaaatacatactctgtcttgttggttgcttccttctaatggatcttcctcttcctcaatccaacatctccttaatttgcatttgggaatgcatatggctctaatctaatctaaatatcaataacctcagatatgcagatgacaccatccttatggcagaaagtgaagaggaactcagaagcctcttgatgaaagtgaaagtagagagtgaaaaagttggcttaaagctcaacattcagaaaacgaagatcatggcatccggtcccaccacttcatgggaaatagatagggaaacagtggaaacagtgtcagactatttttctgggctccaaaatcactacagatggtgactgcagccatgaaattaaaagacgcttactccttggaaggaaagttatgaccaacctagatagcatattcaaaagcagagacattaccttgccaacaaaggttcgtctagtcaaggctatggtttttcctgtggtcatgtatggatgtgagagttggactgtgaagaaggctgagcgccgaagaattgatgcttttgaactgtggtgttggagaagactcttgagagtcccttggactgcaaggagatccaaccagtccattctgaaggagatcagccctgggatttctttgaaggaatgatgctaaagctgaaactccagtactttggccacctcatgcgaagagttgactcattggaaaagactctgatgctgggagggattgggggcaggaggagaaggggacaacagaggatgagatggctggatggcatcactaactcaatggacgtgagtctgagtgaactccaggagttggtgatggacagggaggcctggcgtgctgcgattcatggggtcacaaagtcagacacgactgagcgactgatctgatctgatggatctaagaaagatgaaactactcccagctcacgacctgatcccattagtgcatcttatctccagcctcacgaatgtggaccaagctggacccatgacccaagtaagcccaccccattagaatgatgggaaggacttccatggggaattatggaatacagaagccctctcttgtgctggatggtgttaaatccagagctgagtttgaaattgctggagccattctgtcatcatgggcaaagccaatgtgagggcaaaagccaacataaagtggagacatgaggaaattacagaggctagacttctaatcagactgtgcccaaaggcttcatttccccctggactgttttagttaatgagccaataaatttcctttattaagtcctttagagataagcttcctgtccccctcaaccaaaaatatccttaatgataccactggggaaatcatctcctgagggaagtggaccttggaggggaattagataaaagcaatgtgatgtggtaaagtgggatcacgtctttcaccaagattttttatatttatatgattttgtgtttacggggaaaacacactatgcttatgtcagctcactagttacttgcaagttcttataatttgacctctcaaagggcattcagtgagatttcattccatttaatccccatccctgactcttgtcatggaagctcctaagagggcctgtcatgttagacgtgaggtcaggactggctctaagggtatttcctaagaaccaaaaccactgtcttcccgttgacacccagacacaggtacatgggatccaagcacgtcttccctggccacttaactcctgcctgatccaacttcatcactctctggggagctggtctgagtgtttgccagggagacgtgttcttggatgggaattgtgtatgctccattttaagctagtctggtgggaaagaacctcaggtattaaggatattttgtgcccagtcccttaaatctaaactgttcaggcttatagcaattaatcactttctgtgcaaagcctatgtagttgaaccagtagggaagggacccgcaccatagcctgtgttcaagtcagcgagtggggaagagatatgcatgtttcatcaaccctggtggagatgaaagaacagcaaactgagtcccaatattctagacacttttgctttcattgtgctatggtaaatttcccccaagatcagcaaatcaggtcagatgaatgtcttcctctgaaatggaaattatttaaaactgatgtagaatgaatctggttcactgtctccaggaatggcttcctcttggatttgtggcttatggtcctagtgaagtgaaagactcctgtctgactcttcgtgaccccatggactgtagccctctaggctcctctgtccatggaattctccagccaagaatactgggatgagtagccatgcccttctccaggggatctttccaacccagagactgaacccgggcctccagcattgcacacagattctttatagtctgagccagggaagccctgatttgtaccaaatcaaaaatcgaggttaccagagcttccctggttgattggaacacattgattcatttttttcccccactgtgtcttgtgggatgtgggatctagttccccaatcaggggttgaacctctgccccctgcattggaagtgcagaatcttaaccactggaccaccagggaagtccagaacacatctattctaaataaaagtctaataagctctgctgcattatgacttacctggtgtgacataattatcacaagacaatattaaaaaaaaataatgtagaggggaaacgtttgttaatagttacctgactcttcatataatggcaggtggctctgattctcagaaatgattctgattgtctagacctcaatcagagcagaaatgtcaactcgcccttcaattaaagttagagatcttctcctggcgaaattgaaaccaattttagctcactcatgaaaaaaaaaaggtggtgggggggtgggggtggcggatctgtgagaaggcagctgagcgagctcacagaatcgagggcagcagctttcccaggcctagggaagaagagaggtcagtccacccaaggtcctcactgagtggccccagctgaagggccttctctccaaggccctcccagaagatggcaagctcccatgccgtctctttgtgcctctgctcatgtttcaaatgttagaggagagcattgcatgggatcaggtataccaggtgtctgccctttagaccaaggaggacccagggagtgcagagctctgattggctgaggttgggtcacgtgctcactcacaggacctgcaggggcactatgtctatgaagaaaatgccaacaaacagagccattgctcaagtatcaccctctgaaactttcttgaccccaaaggcagatttgtttgctcctccagggcttccatagcacttggtaaacacttggatgggtcaaagagaaaagtttacgcaacagaatttctccaaggagggaactgcgtttgtttaccaagtatttggtacaggaagtgagacctcagagcctcccgagtatgggtgggactattctacaggagacaaggagtggaatttgcttctcaagagagatgggaggaggaaaagacggcggagagatttagggatctcgctggctggcaggacagctgagaaaatgtctccagcgactggcccaccatcatgcccaccagtcctgatctacaatgataggaaactcctgagacgaatgcttgaagtgagtggtccgggagaccgtgaagggacttggtgatgggttgagtctggggcaagcaaagttgaggcagcaggcggacatggatgctggggacagaagcactttaattccagtttagctttagctgaaacatcaagaagtagcaaatggacttgtggacacacaggggtaaggggagggtggcacaaattgagagagtagcattgccgtatattgtatatatgctaccatgcgcgaagtagatcgtcagcctgaagcagctctatagcacacggagcccagctcagtgctctgtgatgaagtagaggggtggaataggcgatgcgggagggaggcttatgagggagaggatatgtgcatgtatatatagctgattcacattgttatacagcagaaatcaacacaacatcataaagcaattatcctccaattaaaaataataagttttttttttttaataaaaaaaaaagaagaaacaaaagtcatggggaagctggtgtcaaatttaaccaaatccctgtagagtgggtgcagggaagcaagagggtggagtgagtgccttcaggggggacccgaaaactcagtccatttttagaacacgaatcgtgtaagactgcaaatatcggtccccagtctgtgtcccttagtggcccatgaaaacatgactttaagaacaaggacaacatcttatgaattttgacatcacccactccttccagaacacacaagaaatatttgctgaatgagtgaatgattcatacatgagtgtgtcagcttagttatttacaatgagtgctattccctttgggacagtaggtacaattttttctaggtactttcttctggtggaaatgtccagtcctcaaaatataatgagcatggaatttctacaaggaggctggttgttgtttaaggcctgctttcaataagcaaaaggagttgggttattattgtttataatttctatgttgacaaagtacacctatctttccaatctcattttagtccttagaacaaaaatgggaggtgggttatcctcctgctcttggccctgatggcaccctttccacccatactccaaactcatacgtccaaactcttcaaaccagctccgacatcctctccttcagaaagccttttccctttacccagtatcatactgatctgctaaaaaaaaaaaaaaatagcaatacttatttaaaaatagcagctaaaatgaaaggacctggtgtataccaggcattcgtgttctacgtgtattatttcatttgccttgttatccatcctctgcatcccgggtcctatactgcctctatgttaacacccacaaatgaagctggagataaaccacacagtcatttgatcagaggcagtttctataaagaatgattaaatgatgataaggaagaaactataaaaatgcagagagaatactaaagtataccttagaggtgagggagagtgcccagggaagagccaacttggaagggggtgggggtcacttccccaaggctggggtgcagatcttgttatagcagatgtagctgcagccactgggcggtggacaggctcacagggttgactggtccacagtctctaagtagcagttaacagtttctctggcccgggagagtcaaggctgaaggatgggtgggtatggagaatcagagtgtagggagcccactcacaggcaggttcgcacacagtctggtgtgcactgcacccatgacgggaagactacagaaaacagctgtctaggacagaggccagcagaggctagtggatggctggtagggaagtgggtcattggtactgtgcatggactgaaaatttgtgccacctcccaccaaattcctgtgttgaagtcctaatgcccaatgtgatgatattagaatgcagggctctggggataagggcttttggatgtagggctttggggtgataagccttcccagctgacacagtggtgaaggacccacctgtcaatgcaggagatactggttcaatccctgagttgggaagatcccctgagcaaggaagtggcaacccagtctaatgttcttgcctggataatcccaaggacaaaggatcctggaaggctatagtccttgagatagcaaagatttggactcgactgagcacgaacacacacaaggtttagacgaggtcatgagggtgggacccgctaccatgggattgtgtcttcataggaagaaagacacaggctatgcactctttgtaagagaagcatgtagaaagtgtcagtgatttgggacaatgtgctgcaacagaactgaaaagcggctaaatgaacctcaggtcagagcagaaaagggaatttatgtcattcaccatcagcattagcagtataattcgacacactggcaaatttaatgaaatgaaaccaaccagcaggctgatgttgatgagcctccaataaaagtcgcaaatgtcaaattaagccacatcatttccatgacatggattttccgctctcatgtgtgcacaaatcctgaagttcttcagagagtattgtaattattatttgccagggagatgctgagctatctgcccccgagtcgtgttcctcctgggttgtttgaaaccctgactgccttgtgccttctgcgctcagctaacccagagcccaggcaagcactttcatgcatgcgtgtcttcattagcaggaagtgcagaggagagcccctctaggccaggcagggtcctttatcacacaccccctgctgtgtaaacccacttagcacgagttgtattagaaattttaattagcagaaaacaagtaagtgtgtgtgtgggggggtgggggtgggcgggtcccagctagatcccaggctgtgtcccctgctgggttggatgtgtctgagcaagtgttggtgaggatctttgcgcaaaggacagagaacagatctcctcctggggaaagagagatgcaaggaagtaagtgtaggactctcttgggtcctgagggcccagaagccctagcaagaaccctgagatttactgggggctactaacatcacacctggagaataaaatggcaacccactccagtattcttgcctggagaatcccacggatagaggagcctggcgggctacagtccatggggtcgcaagagttggacatgacttagcgactaaaccaccaccaccacccccatcactaacatcacaagcactccctgaaccatacggtggccggaggcatgtggtgtgctgactggcttctgtctggagcgggagttgacacagcctcttccgaaacagcctgcatttcatgggagacaggtgaacacttcaactgaactcagggcactcagtagagggggtttggaaagatgggaagtgggcggcgaccacgtgtcctttaaaggtgccaaaggaagagaagaaaacgaacatgtaatgatcactaccaaacactgggcactttgatgcacactagcccaggtggtcctttcacaaacatcatgaggtgggtgctattagggagctgaggcgcaaaacaggtaagaaaccttgtatcttgtcaaacagcaggcaagagactcaaagctaagttcatgcaatgttttcccaaattatttgtccaaaacatgccttaattttcatccaaggtgaggaatgggaagactactgcttcaggctaggatcatttctctctcaggtcctgtgcacacagtgggctggctggggctctgctctgcatcctgctggcctcgctctgagacgtgggtttctgaagcaatcactgtctctcttgatgactaaatgctccagcccaggagagacacacatcacatgagcccaccactcacaagctaaagaagctcttggtcctcccaaccgcaagggggagggcaagtgccctccgggagtttgtgatggacagggaaggctggcatgctgcagtccgtggggtcgcaaagagtcggacatgaccgagcaactgaactgaactgaactgatcattaatcttaagcccatacagctggtccatggtaaaatggtcagagggcatgaaaatattaaaggcaggaggagaaggggacgacagaggatgagatggttggatagcatcaccaactcaatggacatgagtttgagtaaactctgggagatggtgatggacagggaagcctggcgtgctgcagtccacagggtcacaaagggtcaaacatgacttagcaactgaataacaattcccggtgctgagtgttcagaaacattaccatcatccccagtggccaacagaccaggggtttcgtgacctcatatgagagatgtgtctcactgggggtaacaccgcaacagtgggttgggggtaacccccaacagcaggctggaggagggtgaaaagtgagacacgttcatgtgtgtgcatgcacgcgtgcacgcacacacacacacacacacacacacacacacacacacacagagtggtggatcatctgctgggcagtgaagttaggtttcttcctaacagcgcttccttcctgccatttgtagggggtgctggactcattgccctggaggagaataaagatgccaggccataaacctgagggcaggccctgttcctgtgaagcccaggctgagctactttcctgaagagggaggcagaggacagggccgactagaggagagcatgcgggcagaggtgttcccatgcccaggcccagaaagaccttctttcgttgggggaacagagggtcctcggccaattcactcttggatccctcaaggtggctggggcctcctgggccagtggccttggggcacacacctctgtgggccagatcctggccttgaggttgctagccccagcaggactcccagcaggactccagtgcccaggagctggggccacagggtcagatgtgggcacacccatagttctgcacagttagcataggagagtggtggcctcagcgtctcaccaacactctggccttggaggtggggtaaggagccccaaacaatgctggagtccagtgtgattgatttaaagcaataagcctaatgtttcctgcacaaccaactttgtggaataagactcaagatagcgcacataagcacacatctatttatatatatatacatatatagatatatggtgactgttttagtttaggggatctttctggaggcggggtgttgtggttggtaaaaccagttaccaaagtttcctcctttttttgatgacaagcacgatttgtgccaggtcttaaccacactaatacttacaaactgaattcagatttctgctactatcaatctttaaactgacaagcttgatctcccaattatacaaaattcgtttcagtgagttaaatgtgacagccaaaaataaaagtacagaagtattttctagaaaagcacatagtggtaactcttagggcccagggagcaggctgagattgggtaggactgtgaggctcctgagaaaccaaggttctgtctccagttctgggagatattgacagggtgtggcctagtaagtcatcatggagacatacacatactgccccctggtggtccttctgccaccctgcaaaaatcttcaaagggtcactaactctagcaaagccttgttctttctctcaagcccttagtatcccccagtggaacttgaagtaaagaagagggtatccacaaggctcccatcaggagaaggaacgaagggaagagttctatgagtttctctagccatccatgatgcaatactttgcttcagtccaagcttggactgcaaggagatccaaccagtccatcctaaaggaaatcagccctgaatattcatcggaaggactgatgctgaacctgaaactccaatactttggccacctgatgtaaagaactgactcacttgaaaagaccttgatgctgggaattattgacggcgggaggagaaggggacgacaggggatgagatggttggatggcatcactgactcaatggacatgagtttgagtaaactccaggagttggtgatagacagggaggcctggcgtgctgcagtccatggggtcgcaaagagtcagacacgactgagcgactgaactgaactgaactgaagccctacattgctgcctggcaggctacttcttggtcctgcctggatgcaggcttgacccctccctgggccagtgggggtggatcctggtggtctttgttggcttccttgttgtcaggctgaacaagatgtcccaagctcatcttgtacatttccttccccagacctagaatcaaagggtccctgattcttccagtaggaaatacaatgtgaaagccactcaggcgagtctgactctttgcgaccccatggactgtacagtccatgggattctgcaggccagaacactggagtgggtagccgctcccttctctgggggatcttcccaacccagggatcgaactcaggtctcccgcattgcaggcagattctttaccagctgagccaccggggaagcccaggaaatactataaatagactgtaatctggagggtaggagtatactttgctactggatttgtttcttttgtttactgacatgataagcaattaggttcattagcttcatttttctagcatattgtagagatcactgtgttttagttgtttttttttttaatgtaaaatgtttacattttctagtcaaagctataaaacaaggtacattcagaaaagacttcttacttttttcctccctcctgttatgtcccttcccctataggtaagcatttttatttagtgttaggtttattcttctgttgtttatatttgaatatgcaagcaaatatgcatatcatttatcatttacacacatgtatttacacaaaggtcacattatacagtctcttctatatttctgagcatgtttctcaaatccatacataactgaagattggatgagagagaagaaaataattattgtcttagaattgacttcattgtattaaacaatgttttcacatcactccaggccacagggccctgttgggtagaggggggaaaggggtggttgaacagaggggaggctctaggattaccatgaccgcttcacccaagcaaacagacttctcttctccatgttaagcaaccatatcaattttgatctgaaaatggttcctgttactaaaattctaagagaaaatggccacaattgtcaacccaaatctgctgattctatcctctgagaaaggtgcttggagagcacaggattcaatcctattgtctggtgttgcctaaacttgagtcccaagaaaaccttcttgggaagaaaatccccatccattcaaccgtcaagtaaaggacctgctaaatcattttgtccatatcttcatttgacggaatccattatgcacatttatgaaacatctttagctctaaggagataagaaaatacaaaggaaaagcaagaggctgctggagtttgaagtgaactgtcattttgcctcgagtgtacaaaatttaagtctttgcaggcagggtattgaattagctcaagaactgccgccccagtgaaagacaggcacacaggctgactttcttttgctattcaccataccctcattatgccacctggaaaaaacactcttgattgttaaagtgggcaggcagtgggcacaaagtccatatgttcagttcagttcagtcattcagtcatgtccgactctttgcgaccccatggactgcagcacgccaggcctccctgtccatcaccagctcccagagcttgctcaaactcatgtccattgaatcagtgatgccatccaaccatctcatcctctgtcgtccccttctcctccaaccttcaatctttcccagcatcagggtcttttccaatgagtcagttcttctcctcagttcttccaatgaatattcaggactgatttcctttaggattgactgatttgatctccttgcagtccaaggactttaaagagtcttctccaatgccacagttcaaaagcacaaattcttcagcgctcagccttcttcacaatccaactttcatacccatatatgactactggaaaaaccatagatttgactattatacagacctttgtcagcaaagtgatgtctttgctttttaatatgctgtctaggtttgtcatagctttccttccaaggagcaagtgtcttttaatttcatggctgcagtcactgtccatagtgattttggagccgaagaaaataaaatctgtcattgcttccatttttttccctatttgccatgaaatgatgggatcagatgccatgaccttcattttttgaatgttgagttataagccagccttttcactcccctctttcacccttatcaagaagctctttagttcctcttcactttctgccattagagtagtatcatctgcatatctggggtggttcatatttctcccggcaatcttgattccagcttgtggttcatccagcccagcattttgcatgatgtgctctgcatagaaattaaataagctggatgacaatacacagcctttttgtactcctttcccaattttgaaccagtcagttgttccatgcaaggttctaactgttgcttattgacccacatacaggtttctcaggagacaggtaaggtggtctggtattcccatctcttgaagaattttccagtttgttgtgatccacacagtcaaaggctttagtgtagtcaatgaagcagaagtagatgtttttctgaaattccctcgctttctctatgatccaacaaatgttggcaatttgatctttggttcctctgccaacatgttcatctggaagctttcagttcacgtactgctgaagtccagcttgaaggattttgagcataaccttataagcatgcgaaatgagtgcaattgtatggtagtttgtacaattaatcacttgttggagttactgatactattccaatctgtatacatgaagtcagtagatttttagtttgactttaaataattggttagacatgaatgcacagagatgtcagtggatggagtgactggtgaagcccacactcaggatcccatctgattgcatttatccagcccttctctggaccataatggagaatgaatctgtaagaagaacaccatccctgggcagctggaaggtgtttcaaagagcatcaactgaaatctgtgtcctccacatacaggagagtgtaggatcctatgtaatcttattagacgagctcctaacacatttggaagggggggttgggtttcaagcttaggtcgtactagacctaagaaatgaagaaaggctgttagcagcagacataccttagagcaggagagacagtctgtgagcagcagaccaggcttgagacctcgtctgtacaatcaccgagcccacatcgtgaacaacacttattgttaacctgctcgggatgaatctagtggttaagaaaaggtgaaagtttgcttaacgaggcagagacatccatagtgtatttcggcagctaaatatttcaaacaaaaagtctggggtgcttattaaaaggtcacctctcgccagtctatctccaaaattctcatctcagggaagcgcacctgcctgaggacatcttcccaaccacctgctggggcccaggatgtgctgagatcctgcaggtctcctccaccccggagggaagtcaggggtgatggagcatctgcagggaaaagaggattgagactgggttctcacacacaagaggctgtttaaaatgcaggttcctgggttgggctccatatccaacatgtcagaacccttgtgggggagactggcaatccgtgtacaaatttgaaccccctctcaggggattccgaggagatggtccttgaacttcctttggggctttaaatatggggagtgggaggtgaagcagaagccaggctgggaaagagcatctggagaggtagaatgaggagtgagtgacagaagggagccgcgaatcctcattcagcccttcactcgaacacccacttgacatcgatgacccccaacagttgtcatcttcccatctcacaaataaggaagcaaaagcacagaaaggctgacctctctgtaaaaggcagagaggatacggtcctctagatcagctctggggctgcacttaccacccccgagcaaggaccaggcaggcagttcttggtctttgaaatcgtgggtcatcaggtcttcaagaggacacgctgagaacagaggccaggctgtgaagagtggggagggcgtgaggaaacagaaatcgcccatttggggaacttccctggtagtccatcagttaagaacccacctttcaaggcaggggacgtgggtcccatctccaagcagggagcctagatcccacatgttgtgggacaactaagcccagggcagaagacaagatcctgacacagacaaaaataaaatgaacaattaaaaaaaaaaaagaaacagtgctatttgcattcttatttcaagtgtgtgtgtgtgtgtgtgtgtgtgtgtgtgtctgtgtgtgtgtatgtgaagggcagtgtgtgtgtgtgtgtgaaggtgtgtgtgtgtgtgtatgtgaaggtgtgtgtgtgtgtgtatgtgaaggtgtgtgtatgtgaaggtgtgtgtgtgtgtgtgtgaaggtgtgtgtgtgtgtggtctgcaaagtcaggaaaccaattatgcctgagcaataggttcgttgttgttcagtggctaagtcgtgtccaactctttagtgactccatggattgtagttagccaggctcctctatccactgagccatgttagttacaaataactagttagttttcaaatattggcccaatattttccttggccctgctagctcagttggttaagaatctgcttgcagtgcaggagacctgggttcaatccctgggctgggaagatcccctggagaaaggaaaggctaccccactccagtattctggcctggagaatcccaaagagtcagacacgactgagtgactttctctttcacttttcacttttcttggcccaatcctttctagatgtgttgaacactaatatattgatttttttttgtactgtacttctttttttttttccaaatttgcaattagccccactgaattaagtttggagggacttcacctgaaaacacagcaagctggttatttgaaaattgtaaagaagttctcccagctttgctgcctgctgcacacctcacaggaggggacagagccaatgggagccggaggggaaggcagggggcagggaaaggattttccagaaggagtaagcttgcattgggtcacagggtgagggagacgcaaaaggaatggtgggggagggaagctggctgggtgggggtgggtggcatccaggtgcctgggcactaaaggccttgctaactgtgggccaagggggtgcccaggggagctgtgctggcagcctcagtttccactttgcttgaggcaacatcttcggctccaagcataggaggggtgcccacggccccagtgggcagaggctgggggcctggggtctgcagtcccctctccctgcaggccagggggacgctgagtcctcgactacagctccctgcagagactgcagggtgtggctggtctccaagtctgctgggggacggcagcctttgtccccatgagccctgccgggtgatgcctctgtaactgccgctgttgggcctggaaaaccacacaagggtgtttaaccaggagctggactcctcactgggcaaagttatgcttccccaccataacctggaaaccatagcccaccgccctgctccgtaccctgcggtgtcttcctttccttctagaagagcccagacttcttctcacgcaacgcgttgtttcctgtttccaccctgtcctttccacacttgcattcttaattcattccattcacactgctccccactctaaatatgcccccttacacacacacacacacacacacacacacacacacacacacacacacacacacagcttcatgctcacagaacccacgactaaggaagctggtagcctgggcacacttgactttctgcctgggcaggcagtcccttccctctctccgtgataagccacacctcttcctctgcgctcggctccagcttcatttcttcctgccactctgcccacaccagccctggactctgacgcctcacttccctcacctccagtgtctcactgaccaagaggtgctcctcaccaccagcctgactgcccccaggacccgagcttgctctctttggacccttatccagggcacagactggaggcacatagaagttgctctcatttttgctgagtggacgactggtcacatccaaaggaaggaaagcagggatgctcagctagctgcctcaccacccaaagtaaagactacctttcccagcttcccttgagcctaagtctggttggtgagacttcctggaaagtcccttaaaagaaaaaggataggtccttctttccactttttctccttctcttctgctggaaatgctaatgcaatgacttggtcagcagccattttggactaggagttcaaggacgaaaccaagtctaggacagtggaagaaaaagataggacgctgagctctttatgacgatggatccatcctattaaccgtgaactgccaccttagcaccttaggacttcttgtgttggttgcggggttagggggttatctcctactttgtttaaacctctgtggttagggctccactactcgtagcctggcctgatcctggctgacccatacagccagctagagagggatgtgaggacttcctaacaggaagacgtggattctagctttgaccctcctgtccctacaggggtgtgtgcatgcccctaggtgagtcagttaccacctggcctcgtcttcatttgtaaaataagcttcaagatcactgtcctgcctatatacagggtggttgtctaaactgaatgaggtcaagtatgtaaaaatgttctgtaaaacagtcacagatggaaggagtttgtactgcctggggtgggggtgcagcttggtccgttgattggccaggtgtgggctccatcaacccagctgagcctggaccttccttgagtggtcaaagccagagccaggaggcatctggctccgtgttcctatttacttctgggctcatcccagggcagagccattttccaacatcccacctcctagagttggggccgtgtggggggaaacactctggcctgtggaaagggagtggcaacatggttgttagtgctggtgaggaccaaacaggacaagagggtccatcagccaagctctcggaaggaatcagtgccaccaacatcacagagtcccctccaggggacgtgtccatgcgcccagggctgctgtgtcttgacacccactgtttacttcatacaagcgctgccccccccaaaagactccaggctatcctcaccatcccttctggtccaccccaccaggagaaactttattatccttatttccctaacctatcacagatggtctgaaaagaaatgccagtgaacatcatttcctttgattaaagtatcttaagatggctgtgtctacccttattacaaccaaatgataaaaagcagtgagagttttcctaaaagagtggaaaggaaatgaggtcagtgacagtagggctaactgtggatgtgtttctggaaccccagcctgtactgtaataacgggaattcttgaggtagtggcatggcttgtgctaagcatttaaagcccataactctagtttacaaatgagttaactgagcctcagggaagtaaagtaacttgtccaaagtctcctagttaacaagctggaaacttgagcttctactgaggtccatctgattcctgaagcccagtgcgtttcccattctcttctgctgggagttcccatgctgggcataaagcagcatttcttaatgacgagtctgatgttacataccccaacagcgcatttgacagtggccctttgatctccagttacaccaatgttctctttccccttcttgttttcctaatgattgaacaaatcctcgaaggaatacaatcctaatctcactttatttgatcattttggctttcaaagaaaaataactcccgttggtctatcttgttcatttgataacctaaaacctccttttttctgtttttttttctcactgcaaaatcatgtgtcttgaaaaggcatctcctctggctcgattgtgtgctgaaatacattttactgggtgtccagttggaggcagttcttttgttggttgatgcctgtctgatgtcagagagccttacgccttgtgaattgtgcggtgagaaagaaaaggtgggcttcattaaccaagccaagcatgcagctggacacgtaggctttagaatctgactgatccaagtgtctgcttaaggtctcagtttccccatctgtaaaatagagggactgttatgagaatgaatgaatgctctgtgtgaataacgactcttaactaggaactctggatttgaaactcagctcctccacattggagcgagttatgtatgtttctgtgcttcagtttacccttctgagaaagggagacagtggcaattcctacatcgccagctgttgtgaggatgaaatgagataagtttgtgtagctcttattgcttgtcaatacagaactctggacagggtgagagaaatgtgaggtgggggcattcaacatccccacactcaggcccctgacactgaagtcaccaagcaggtctgagtcctattacttgtcctcaaggaaaaaaaaaaaaaaaaaagggaaacaaaggaagatttgacacagaagagaagaaagtcatgtgaccaccgaagctgagtttggagtgatgtggccacaagtcaaggaatgctggcagccatcagcagctgaaagaggcaagaaatgtattctctcctagaacccatggagggatggtggccttgctgacaactcgatgttgactcagtggaactgatttcagacgtcaggcctccagaacggggagagaataagtttttgtttgtttaatctaacaagtgtgtagtcatttgttacagctgtcacaagaaactcatacagcacagtaggctgtaaagttgggggtgcagctgagactgcctggttccaagtgactggcagtgctgggtgaaattcatcccagataaaatgcatgaaaacaaaatgctgtgggagtccaccacttagttgctgaaaatcactgaacatctcttttctgacagaatgtttctgcataatccaaagacttttaggaagtgagtagggcagggcaacaagcaaatattcagatttggagctgctgttgatggtagttgtaaggattagtggtggcatttttcacttttatattggctagcagaaacctagtctcaccatctgacgtataggcaagtctgttgggagttgggtagcaattttcagatgttgttttcaacatgccctagcataatcacttcaattgtaaaattaatgcttgaacatacataaacaagaatgagttttttgatatgtttaataggaggcaggtgtttttctataaaagtgaaaaacgccactactaatccttacaactaccatcaacagcagctccaaacttgaataggatgctgttgtatcaaccacaggtggctcagcaaccagggtccgaaaatgcaaatgcatgatgctctaatgacctcctgttgggattctgcagatggtgagtgcagccatgaaattaaaagacgcttactccttggaaggaaagttatgaccaacttagacagcatattaaaaagcagagacattactttgccaacaaaggtctgtctagtcaaggctatggtttttctagtagtcatgtacagatgtgagagttggactataaagaaagctgagtgccaaagaattgatgcttttgaactgtggtgttggagaagactcttgagagacccttggaatgcaaggagatccaaccagtccatcctagaggaaatcagtgctgaatattcattggaaggactgatctgaagctgaaattccaatcctttggccacctgatgcaaagaactgattcattggaaaacaccctgatgctgggaaagattgaaggcaagaggagaaggggatgacagaggatgagatgatcaccaactcaatggacatgagtttgagtaaattcatgaagtccatggggtggcaaagagttggacatgactgggtgactgaactgaactgaactgtttggactcttgcagttggaataggagatgaattggataagtaggtgctgtagacacttgtttatgtcacccagttgcccactaagtcctacttgaaccaactactgtcatagcttcccaggttcctcatggggaccaccaagttgccttgggggatctgcatgggatttaatttccttgggtgtctcttgctcacccctctgcctccttgctttcaagcaatgggaggaaaaagccagttcagccaccacttagaccacaactgtcaatggcaaactgcctccccatggattactctggtggactgaaactggtaggcacactagttaatttcaactttttgtgaccacacacttggttctctttttctcccagacctaaattttgaccatacaacctttagctctgttcacctcaactcaccaccaggctcctttggactgggttaacctgaatcctcccacggacataatagccctcaaagtggccttgacgagaatgagagtcaagattactaatttaccaacaagatttaatgaaacccctcagcaacccatcagcactttaccaaagcccttaggaacctcagttctcacaggatccctgtgaggtcattcttagagtgtctttggccacagtggtccagaatcaagaccaacagaatcagtaaagatcatgcccacagcaccgtcctaccactggttggagggatcaccacccttaagaaagtttaccaagatagtaattttcccatcttcgtactttggtagttattgtcctccacttgctgaggtttatcctttcaattcctttgctgattaaatcactgaagagtatatactggtaagaatagacaccatccacagactgcagacaaaactccttcctattattgatgatgaaccatttcagagaagaccaggctgagtctaaagggttcaggtaattgtaaggagaaggcagagtgagtagtttatggccataggacttggctacctcaggacaacatgtgacgcttgttaagttaaccaccgaggggacatgggcctgggcctcagtctctttgccctccttcggcctcgtcgcgtcctgccgccttctctctttgaccacaatggcgcacttgccataggccttcttcaccacatcacagaactcgaagaagaggttgtcttcctgtttgatgcataactcatcccttaggaacattcgatatttccacggcacccatccttgactaccaccagcatgcacaacacaccatgttggagtcggcatgtaataaccatcactaaaatcttccccagttacaagactctcagggatatcagtttccccaaaatatactgttgtaaacccatcgtattgcaatgttctcagtgtttgcaaatactggagacattgcttcttcttgatgctattgaatagatttctggtaatgatgtttctcaaaagaggttttgcaaagtgaggcatgggaggtcttcaagagtttttcaaaatttgcctgcctccctctggccagagtaggatgatgacctcataaagggctttcttacagctgagctggtcccatggatacactttggattttaaagcatcatggaacacactgagaacaattcctgtctggcttctatgatatgggaatgggaactgctggctatccatgatggtacatcacatctgcagtaggtctggagagagactcacagttgtgttagtttgctaaggttgcataacaaaatagctgaaattaatttttttgcagttctgaaggctggaagttcaagatcaaggtatcacaggtctggtttcacctgagacctttctacttggcttgcacatggtcaccctcttgttgtgttcttatttggactttccacctgtctctgttctaatctcctctccttataaggtcaccagttctttgggattagggtccatcccttgaacctcattttaccttaatcagctctttaaagaccctatctccaaatatcatcacattctgaagtgctgggagtcagggcttcagcatgagatttgggggagacacagttcagtccctgacagcaacctgttaacagtgatgagccaagttcctgactcatttccacgtgggtcatgagggtcatatttatatttattcgttcatccattctgagcaccagtggcacagtcatgacacatctagtgaggcctgaacatgcatatggtttctgtccatgtaaatagcagagacattgctttgcccacaaaggtccttatagtcaaagctatggtttttccagtagtcacacatggatgtgagagttgaaccaaaaagaaagctgagcgccgaagcattgatgcttttgaactgtggtgttggagaagactcttgagagtcccttggattgcaaggagatcaaccagtcaatcctaaaggaaatcaaccctgaatattcattggaagcactgacgctgaagctgaaactctaatactctggccccctgatacaaagagccaactcattggaaaagaccctgatgctgtgaaatattgaggacaggaggaggagacgatagaggatgagatggttagatggcatcaccgactcaatggacatgaatctgagcaatctccaggaaatagtgaaggacagggaggcttggagggctgcaatccatggggttgcagagtcagacacgacttagcgacattacagtgattaattatcttctcctagtgggctgctgtctatggggtcgcacagagtcggacacgactgaagtgacttagcagctgtagtggcagaagagagtatcagaaagaaggagttaaacccccaacagtttacagaaaacccatgggcatggtcagtggtttattcccatgcttaggtcatctgctacccaatttttcaagaagatggcaagatgttccacaatttccacaactgaggtttaaaccccaaagtctaggcaatcacctgtgtttaaaataaacctgaactagattcatttcgatatttagcaaaactaatacaatattgtaaagtttaaaaattaaaaaaaaaatagctgaaggatattttcctaaaataaacctgaactacgtaggcatagattctccatgaaatgtcaggggaaagtccccctctgattattttgggatttgtagcttatagagtcaaaatctcctatatttaaaactctgtgtgtgtgttgtgtgttcagttgctcagtcgtgtctgactctttgcaaccccaaggactgttgcccgctgggctccgctgtccatggcaagaatactggagtgggttcccatttccttctcccgacccagggattgaactcatgtctcctgcatagataggtggattctttaccactgagccacatgggaagccatttaaaactttgattctctataaattccgttttctaagttgtgacaaggagcatccagcactcatagcaaaatggaagaaaaatataattccttttatccctcatgcttaaaaatccaagttctaccaatctgggccagggtggcatgggggtcagggtggagatctactaatattgcaaattgcaaattgcccatgtggctgcaagcaatgagaccaaatatttcaccatatctatgactttggttactgtgtcctcattccccatcctctccggtatcttgagagaagtgaaaaaacaggaactttttagtagagacctcagtctgttagatgcagagaaaaatacttacgggccccgctatctcaaatctgaaagtcttcttggcattctgtccttcatctcatgccagcaaatcccaacaagcaaactggtgggaaaaggacaaagcacacgtgggcccctctttcttcttcgcaaagggattcgatagcctgacctagacttggtacccacccttgcagacaggtctcaccccagctcctccctgcaaggacctcacaggctcagcagaggtgccaacgctgctggaggggtgaacagcttccctccaccccaaggatgcaaacatgagaaagggccacagtgcttgcaggaggagctaaagaggagacaaggagtggatgtgccagggagcagataagaaggatggagggctgggtgatggggaccatctacagcccagtcctctacagaggggcacctctgatctggcgccaacggcaaggaaatgctggaaacgcaaaactccctcctcctctgactacacagaggagagcgagggggagggagaagacaggcacacatgtactctggcttattctacaaaggttattttattttagcaaacaaaatactggttcttctaaaagcatataaaaattcacatcattttcagttagactagaggctgcgagtttgtcttctgacatattgttcaataattaagactttcttctcagctggagtccacttgagctgacagttacaccacaaaatctagaaaggaagaccaaagggatgacgatgaactatctggcagaataactgtgaatgttttacttgctcagcatctacgtttatgctcagctatttaaactgaaacagaaactgcggaggcttgtctatcgatcatgtatttttagcatcacaatttcctttcatctaaaaatcccttcggtgtaaaacaaggctccaggctaaacgctgataagccccctacctgggagggtaaccggagccccctggtcagttctgggctgggtgggcaaccaggcatctctccttcacattgggctgccatggacatttggggaagggaagaagtatctgtgatctcacatctaatctctgcttcctctctgcagttaacgcacaaaatgataactctgtctggattagaagtccaggcaacacttcaatggaaactgccttccctcaccttttctaatttccaagtactccccgtttccctgctctagtgtgtgctaggttgcttcagtggtgcctggctctttgtgaccccatggactgtagcccgccaggctcctctgttcagggggattctctaggcaagaatactggagtgagttgccatgctctcctccaggggatcttcctgacccagggatcgaacccatgactctgctgtctcctgcgctggcaggtgggttctttatcacttgcaccacctgggaagcacccccccccccactctagtgcctgctcctaaatttcagtcaataaaaatgttgtttttttccagaaggcaaggtttaataacagtaacttcctttgcctgtaacgtgtacagttcgccaaggcccagggagcagtgggcgatgagaggactgcccctatcctagagggaggaccaggagcccagtgtttcccacggctccatcctgaggatgcacacagtgcagccaggggtgaggccctgcggttggatgtccgacctgggttcaattctgcttgtctgtccttgaccgtgtacagggtgggccatgttctcagtctgaatggaccacacagggctgccaggagtggtcagtaacatggctgtctgtgaaatgcttaggaaaatgctagcacagatcactcaagacatattgcaattattattaatgaaaaatctatgagtcctgtaaaggaaatcatctctacagaagcctatctcagggttaacagggcttttggaggtcaccaaacccagctgctgagaagacagtggaagaatcagctgagaggttttcgaaagaacaggtgcccagatccagccacagatgtaacggagtcactctgaggctggaccctgggaatctgcattgtaacaaagaacccaggcaacctgatcattaatcaactttggaaaccactgatctaggattccctgctaccatatgtgagtcctctcattttttagagaaaagcacagacctcaacctgaaaagtgatgaaactgggcgagcacaggagaatgaaggaacctgctgaccgtcattagtccagcctataagctgggggttgaataacttcctcctggtgccttaaaaacaaacacgttctgggcagcccctgtgctatggggcagctcccagatggctcagtggtaaagaatctgcctgccaacgcaggagacctgggtttcatccttgggttgggaagatcccctggagtaggaaatagcaaccccctccagaattcttgcctagagaatcccagagtcagagaagcctggtgggggtcacaaagagttggacacgactgagtgtgcacgcgcatacacacacagatgagctctgagacaggcaccaggctatagcaatgaggaagattttgtgctggtggagtggtcataaggaaggcgttctgggccaggggactaacaagcaaaggccaagagcgtctactgtggtcaaggtggtctgcaggagcatggggagaggcagcagcgggggacacgtgacctgggtgaggacgagtggagaaggacttacatgccgaatctaggagtcagacttcattttgaggtcagcaggatttcttaatcttaggtacaggtaggggtcttatgtgacctgcgatcccacatcctccccatccctgtctgcaatgttaggtccaatttaggtgtttctagtatgtgagcttctccagggagaaggtccacaactttcctgaaagtatcaagagtcctgtgacccaaattctgtcaaacacccctgctcctgtgaagggagaaccattgcaggctcggagcagaggtgaggacttgtccatcccctgtggccccagagcagacggggctcaaaggtcaggacctgcacttggacctgacacagagctgcccgacctccgggggcaggtggggccctgcgccgtcccagagcctcaggccggagggaggcagagttctcatcacatccaggggcacgcccaccctaacctgccgtgtagttcagtctgcaaagcccatacctttcactcccctttagctctctttcttctccgcctgcttcctcttctcagcttccaccttttgctgctttgcttccaatcgtttcctctggtagactttgactccggcaaacgccaggcagaggattagtgttttcgccgccaagatatacagcagcagggggaagtgttcaagcaccttaaagaagaaagaaaactcgtggagccgttcgatcatggataaggaatgttctttcacgtcccttcactcggcacacgtctcctgtgcaccgtgttaagcactgggtaccaggctgggtgggggctcccgggtgcagagatgagggcccagttccaggtttccggcagcctggtttcaggtgcccttcaccactccctggctgctggcttcacagatgccatggctgtgctctctcacaacctgaccatgcactttgcccctcaccccctgagcctgaggcagcggcatggtctgcagtgagcagctggagccgggggactgggcacagccccgctcgggccactcactgacccgtgcacagcacgtgcggcccgcatcggtcacttgactttccccagcttctgcctcttcacctgcaaagggaggctggaccaaatcttccttctgaatccccacccttatgggataccatgattggctcttggttccagctacgcgttagcactggtatttgaaggtaaaataaatatacaagtaaaatacagtaaaactttactgtaaaataaagtaaaacttaaaatgttaaagcttagctacttaattcactgttcctgtaattcttttgttggagggaagttttaatccactggctaaaatgagatctggggaataactaggggattggaattactctctttgtgcatgagcaggctttattatgaaattctatatatcacaagtatctcaaggcaaatagtatactagtctgggaaacacgattagtagaacctaaataataagtatgagctttttgtgtgtgattaaaaattccttcccagataaagtgaaaagctatgccttcattgagagatcattattccggaggaccaagtaggatttagtccagtgaactccttaggtgaaatgccaagcatcacttaactatatgcagcactgggacaaggagactcttccatggagactgcatttgtccctccctctgatggtttaactaaagctgatctgaaatgggtaaatgaaaacttcagctgagaacagtctgctcccagacgtggagggctgtgaaaggatctgaacaaggacttggtctacaccttgttctacaaaggaggacagtaaagctcagggcggtggcgagccccccgcatcacacagctaattcaggaggagtgagagtttgatttcaatgaagtggaattaactgacatcaacaaattatgtcccaagaacactctgagcaactagataatagttttcaaccacagaatcgggttaaacagtaaagaataagcataacctatatacttcatgggaaatagatggggaaacagtggaagtagtgtcagactttatttttttgggctccaaaatcactgcagatggtaactgcagccatgaaagtaaaggacgcttactccttggaaggaaagttatgaccaacctagatagcatattcaaaagcagagacattactttgccaacaaaggtccatctagtcaaggctatggtttttccagtggtcgtgtatggatgagagagttggactgtgaagaaagctgagcgccgaagaattgatgcttttgaactgtggtgttggagaaaactctcgagagtcccttggactgcaaggagatccaaccagtccattctgaaggagatcagccctgggatttctttggaaggaataatgttaacgctgaaactccagtactttggccacctcatgcgaagagttgactcattggaaaagactctgatgctgggagggattgggggcaggaggagaaggggacaacagatgatgagatggctggatggcatcactgactcgatggatgttgagtctgagtgaactccgggagtcggtgatggacagggaggcctggcgtgctgcgattcatggggtcgcaaagagtcagacacaactgagcgactgaactgaactgatacacttcagaaagctcactttggcaaacaagtataaaagactaaaaaggttacgaaagcaaaaaccttctaccctgacgaatacaagctgtttagaacactgacttggtgtccaggcccttcctgcctcagacctatagctaatctccctgacttcccccaacaaccctccaaccatctaattcatctactttcttgaagggtcacagcttagaggagaggcttggctctacattcataagccagctaagaaagaaaagatgctaacttttacctccttggagacaaaagtcaccagtgtggagatataaacttcattttacgttcactgggactttcccaggctgagccctagttagccctgctgctgctgctgctgctgagtcgcttcagtcatgtccgactctgtgcaaccccatagacggcagcccaccaggctccgccatctctgggattctccaggcaagaacactggagtgggttgccatttccttctccaatgcataaaagtgaaaagtgaaagggaagtcgctgacgctggcaagtcactccctcccaattctctccatccctatggatgagcccctggagtcctgtcataatcagacccctattgcagcccacagttcatgcctgagtgctgagtcgcttcagtcgtgtccaactcttttcgaccccatggactgtagcccgccaggctcctctggtcatgggattctccaggcaagaattctggagtgggctgccatgccctcctccaggagaattttccagacccggggatcgaacctgcatctcttgggtctcctgcacaggcaggcaggttcttgaccactagcaccacccgggaaagcccagcccactgttctgcaagatctacacccaaaactaagctctagcagtgacaggatgtacatggaaatcagaagctagaaacccactgaaatggaagcatgtcaacaaacaaacccagggaagtggttttggtatttactttctttttaaaggctgtggggaggaggtggcaagaggcggaagtttgggactgagagcgggcagtgcagtgggagtcaaggacactacacgggctgaagcgaaactttcagggccactgttcctgcaactctcaggcaggtgtgctagacctttcagttcagttcagttcagttgctcagccgtgtctgactctttacgaccccatgaaccgcagcacgccaggcctccctgtccatcatcaactcccggagttcacccaaactcctgtccatcgtcagtgatgccatccaaccatctcatcctctgttgtccccttctccccctgccctcaatctttcccagcatcagggtcttttccaatgagtcaactcttcacatcaggtggccaaagtattggggtttcagcttcagcatccgtccttccaatgaatattcaggactgactccctttaggatggactggttggatctgcttgcagtccaagggactctcaagagtcttctccaacactacagttcaaaagcatcaattctttggctctcagctttctttatagtccaactctcacatccatacatgaccactggaaaaaccatagccttgactagacggaactttgttgacaaagtaatgtctctgcttttgaatatgctgtctaggttggtcataactttccttccaaggagtaagcgtcttttaatttcatggctgcaagtaccatctgcagtgattttggagcccagaaaaataaagtcagccactgtttccccatctatttgccataaagtgatgggaccagatgccatgatcttagtttttagttgtgtgaaatctcttcttttgatttcccttctaacaaaaccctcagattaactcccaaaccttcagggaagtgaatcaagaaaacacagttgggtggtctagctctatatcagttttttaaataaacgccaatacgcgtgtaatgagaatgactgccttttaaaatttattcttggccacgccctgcagcatatggaatcttagttccctgaccagcgatcaaactcctgcccgtggtgggagctcagagtcttaactaccggaccaccagggaagtcccgcaaatgactgacattttcaaaacccccagttgctgaggtactaaggcactgggtgcttgctgtcgctgactgctgctcatggccacaggctgatggaggtagacagggaagcacaggatgtcttgggcgtcccacagtcctttatctcctgcagggggcagggggtgtcactgcagtttgggcagaaggccattcctttcagacactacctggcagggctccctggtagccctggagctgtgtgtctgcccgaatgtcacgaaggtacaggcggtttttgtacagttttctatacaaaactgtgttcctgacacaggaaaggacttcttctgtgacaagtcgggttggcctgggcggtcaagtgcgttgctgtcgctccacaactaaaaagaaagctttctctgtgcagtggctcaccggaatacatcagcgccacccaggaactcgttcacccacaggccaacgcgctcaaactccagtaggtgggaccacaattcatattttaacttgccgaggtggttttgagacgtgctctggcctcggagcaccaagcacacacgctggcccttgctgacgcggcctctggtaccagctgccgccccgtcaccaactactcgcttcagcctctgcccatgctacaaacccttcactacgtctcagcacacgctgagcccggcccccatcgccccacatgctttaatccccctgtctttccttcctggcctttctatgggcagctctggaacaccccacacgtgcgacatgcgcgttcctacatctctaagccctcagagagtcttcactccacctcctgaaccttggccaggctcctcctggagaagagtccccagagccccactgtgtggcccccaggccccacggggctggggaaggagggggtccgaagctgagtgccgaagaattgatgcttttgaactgtggtattggagaaggctcttgagagtcccttggactgcaagcagatccaaccagtccatcctaaaggaaatcagtcctgaatattcattggaaggactgatgctgaagctccaatattttggccacctgatgtgaagaagtgactcattggaaaagaccctgatgctgggaaagattgaaggcaggagaaggggatgacagagggtgagaggttggatggcatcaccaactcagtggacatgagtttgagtaactccgggagttggtgatggacagggaggcctggcgtgctgcagttcatggggtcacaaagagttggacacgactgagcaactgaactgaactgtagtctcctgactccctgatcctacttccagatctttccatttcctgtgatgaaagccagtggctgttctgaatcagaaaatgcttatgataactgaaaaaatacatataatgagatcctaagtttggagatatacacattacacatatatatatatgaaaaacatgggtagaaaatgcaccaaaattgttaatattaatagcagccatctctggatagtgaaaagacatatggttttgacttgatctgatccttttcaaagcatctattttcatgactaccctagtagccaccctgcacctaccccacgccacttccttaaaggacataatgtgacaccccccccccccccgcccctataagacccactgactgtggcccacagccttctgcaggcttgcagctcacaggacattctttggttgccctcgaacttctacttccaccagctgtatgaaggttttacaggggtcagctgtgtttatgccagtcagtatatttaagtagcacttgatgtcataatggataatctatttaaacatggcactcatgaaatatgaccacggaaaagaaaggctatttccatgaaaactaaggtgtctgttttgaaagactcaatttgaattagaaaaaaaaatgctgtcggcaacacaaatgggaaagattaaggaagaagagtgtaaaaatcaggaaggattttgtatgtcgattgcttcttaagatctttttcatccattttgaagaaaccaaaatgtgagattataggtgaaacttcaaaggggtggtttttgcaagcaaggtgaggcacgtctgagggaagtcattgtcctcccaaagaaaaggccttcctccaaaagtctggtgaaaaaaatgtacatttatgtgttcacttaaagtattatataattcctgcattttcttcttttgtttttttcttagtccacttatctctacagaactattctgaacttttacaattaggagaaagaaaacccgcaagccataaatgtttggtgatattcttaccttccagttcatgctggaccaactggggctccactcctggttgtgtgggccacgcagacaaggaggggcgggaacctgcttgggacaggtcccactgttctgatggggaagagaagaaacaggtcaatttgagttttctagacagaccgccttaggaagacttttctctgatggggagagagggcccttgagccaagacagcaagctctgcagagagaagggttaggccaccccaactagcgagacagcctcggctcttgctgagcagaacgatctccttggctgctcttgaccggggaagggagcacagccaagcagaggtgttggccctgctcttaagggaaagcgtgctcccactccattcatctgtggacaaaggtgcccaggcgctaatctgacactctccccacctcctgccctgaacaggagctggtccatggatgggggtatcattttatgtctcgggtcctgtgagtattaattaaaggaatactgttttgctttagtattcatttaatttattgatttatttataaatttggctgcatcaggttttagatgcggcatatgggatcttttattgtggctctcaggctcagcagttagaggtatgtgggcttggctgccacatagcgcgtgcaatcttagttctctgacagggactgaaccctgcattggaagatgaattcttaactgctggaacacgagggaagcctcaaggtaatattggttttcaaaaatatctggtgggaagggactcaaggatgggggggaatggtattaagaaagtcattccgatcttaaaattccctctaaaatgtcagggagacggaggggaaggtgaagcggaagagacaaggcagggacccggccgggacacaggatttgctctgaggcctcccacgtcactattttaggccaggacacacaccccacaagtcagaagacctgagctctggatgaagggcctacacactctggtaagtgactcccctctgggggcctccatcccatctgtaaatgaagacagggagtgtcaactacacgggctctgggggcctctacttctacaattcggagactttcagcgttaggaatcacagcttcactttactgtacccggccatgctaaagtgcactgagtgccagtaactcacctagtcttcacacctgtcccaagaggtgtagtttatcgtctatactctggagtatctgtgtgtgcgcatgcgcatgtgcacaaagtcctgtccagctctttgcagccccacggactcctctgtccatgcgattctccaggcaagaacacgagtgggtcgccatgtcctcctccaggggaccttcccgacccagggactgaagctgcatctcttaggtctcctgaactggaaggcgggctcttcacactagagccacttcacgtgacactgacacgtccacagtcacagtaaggactgggattgtaactcatccagtccggccccaggctctgatcctaacgcagagagctctgcactaagaaatcatggggacgcctttctttacatggacttacaactaggattaagaaaaattcacaggcctttagaatggggaaaatgagataaacttccgacatgtgtttttgaaaactttcacttacaaaagcatctaaacttcatagccaaggtcatagtatcttgaacacaagcgagcagctggcacaagatagccaagctttccccaggacttttcaaagtcagataagctcatgacaggaatttacaccataaatctgtttaaatgagatgaccatgattgaaagcactcatgtgctaagtcgctcagtcgtgtctgactctttgcgaccccatggcctgtagcccaccagtctcctctgtccatgggattctccatgcaagaacagtagagtgggttgtcatgccctcctccaggagattttcccaacccaaggttcaaacccaggtctcccacattgcaggtggattctttaccgtctaagccaccaggggagcccgaaggtgctcattgccttcgtgtatcaaagacttatttgtctataaggaacagtagattttgacccgccctggaaaaatatgttcccaacaggttacaacctgttgctggaattttcacttcgaataatctctgataatctcaggaatgatccatgttgtaaattaaaatgtctatgctggaaaagattgaaggcgggaggagaaggggaggacagaggatgagatggttggatggcatcaccgactcgatggacatgaatttgagtaaactccgggagttggtgatagacagggaggcctggcgtgctgcagtccacggggttgcaaggagtcggacatgactgagtgactgaactgaaggttgtatcaattttatttttctcacctctatttttattgagttgtctacacatataagtagacaggtttggctgtttcccacacattttctgagaccaaatgactcccttagtgaagtcggttagatattaattcccaaggtcaaggaccacaaaaaggtccaaaaaacacttataggaggaagtaaaaagaatgcctggaggtctggccctctgggaatcatgtgctaagtttaccaggagtatgaccttggatgagtcgctgggcctctctaaacctcagctccctactctgtaaattctccttcaaagactagattataaaaacattaagcaccaggctcagcacatgaaaagcacttaacaaataccaaccataattgttatgataaatgtctttccagtaacagacatggtaagctgatgaacataagcaagtggaggtcagggcaaatcagacagcagggcatgggataaagaaccaccaccagatgaccagaagaactggagatctgtactctatgcttgcgggagccaatgacaaggaatctgacctgggggcaatccattagcctctccaagccaaagtgttaccattttaaaaattcaaagaacaacgctgcaactctgaaattcctaagtcacattctctctgatacagagcatctaactgtaaaaacattactggcagctgcctcatcgtcatatctagagtgacaaaattccatctcttcaggaaagaaaaacgtttaaaagtccatatgcaaagcagtggaaggagtatgttgagggtgggggaaagggcaaattaatcaaactcattcccacccactgcctccaaatgacaactcttccccagtcagttcagttcagtcgctcagtcgtgtccgactctttgtgaccccatgaattgcagcatgccaggcctccctgtccatcaccaactcccggagttcactcaaactcacgtccactgagccagtgatgccatccagccatctcatcctctgttgtccccttctcctcctgcccccaatccctcccagcatcagagtcttttccaatatgtcaactcttcgcatgaggtgtccaaagtactggagtttcagctttagcatcattccttccaaagaaatcccaaggctgatctccttcagaatggactggttggatctccttgcagtccaagggactctcaagagtcttctccaacaccacagtttaaaagcatcaactcttcagcgctcagctttcttcacagtccaactctcacatccatacatgactactagaaaaaccatagccttgactagacggacctttgttgacaaagtaatctctctgtttttgaatatgctatctaggttggtcataactttccttccaagaagtaagcgtctttaaatttcatggctgcagtgattttggagccccaaaaaataaagtctgacactgtttccactgtttccccatctatttcccatgaagtgataggaccggatgccatgatcttcgttttctgaatgttgagctttaagtcaactttttcactcttctctttcactttcatcaagagactttttagttcctcttcactttctgccataagggtggtgtcatctgcatatctgaggttattgatatttttcccggcaatcttgattccagcttgtgcttcttccagcccagcatttcccatgatgtactctgcatataagttaaataagcagggtgacaatatacagccttgacatactccttttcctatttggaaccagtctgttgttccatgcccagttctaactgttgcttcctgacctgcatataggtttctcaagaggcaggtcaggtggtctggtattcccatctctttcagaagtttccacagtttattgtaatccacacagtcaaaggctttagcatagtcaataaagcagaaatagatgtttttctggaactctcttgctttttccatgttccaacagaagttggcaatttgatctctggttcctctgccttttctaaaaccagcttgaacatctggaagttcatggttcacatattgctgaagcctggcttggagaattttgagcattactttagtagtgtgtgagatgggtgcaattgtgtagtagtttgagcattctttggcattgcctttctttgggattggaatgaaaactgaccttttacagtcctgtggccactgctgagttttccaaatttgctagcatattgagttcagcgctttcacagcatcatatttcaggatctgaaatagctcaactggaattccatcacctccactagctaaattacaggttgcaactcagccatttttgagttgcaatggcaccccactccagtacccttgcctggaaaatcccatggacggagaagcctggtgggctgcagtccatagcgttgctaagagtcagacacgactgagcgacttcactttcacttttcactttcatgcattagaggaggaaatggcaacccactccagtgttcttgcctggagaataccagggacaggggagactggtgggctgcggtctgtggggtcgcacagagtcggtcggacatgactgaagcgacttagcagcagcagcagcagcagcagcagcagggcttcagcaagtgagaactgagaaagctaaaaatatcagcaggctagtgctctgctgccatatgtacacctgatgcaatcttagaaccaggaggcagctggtgtctgagggctgaactacaaaagccaaccagatggggacagttttgagagacataaaatctacgaagtgcaaagccaaccagatggggacagttttgagagacataaaatctacgaagtgcaagaagttttaaacttcctctggaactatccagtcttagctttaaattcaaagataacaatgacttagaaagagatggctctattacctttcctgcaaaaatatcctgatttttcctcctaaagaaaacagaaaagctactggcttatcttgattaggctaattatagcaatatgaacaaggtatagtccacaattttattcttgctccacctaacagacccaagggtcggtccgtctcttggtatctcactccagccattcattagtctgaacttccctaaattgctctcattcccagcctctttccaccccaacccttcaccccatcatttgaagtagcgatgggtgcgtggaggaggtggggtggtggggagttccagatgaagcgggttttatcagttgggctgacttctgagccccacgccggggtcggctggggttcccaggacaaggggctgggcctctgcccctccgtgacttggagggccaggtaaaggtcctctccagcctccacactggggttgggggcaaaacctgccccgctcagacctgaggatgagggccaagggcgacggccgcttaccccacctacacaacagggcttctgggacattcgctcgcccccaaacctctctctcttggaaccacatctgggtccccctcttcggcctgcgtgccagcctccacacgccgcccccctcccacccccagccactggatccgtgcattttggggtgcctggacaagccagccaggccggacgctccgcgggggtgggccgtggtggctggcacccccgcggtcccgctggagagcgtcaaggagagaaagcgcgaacgcgacgcctgggcgtcccccaaagagcagccggctgcttttgtgtccggatcccgcggacaccgacgccgcccacttacagctcaaggccgcggaggatccagctccggagccgcgcgcaaaccaccactcccacaatgccgcggggaaactacacgtcccgaaatgcaccgctccgcgcaccggagcaataagcctgctcagggagcctgagccaccatagtgggtaggcgactctacgtcatggtgggtaggcggggccgcacacaaaccacgactcccaccatgccgcgggaaaactatacgtcccgaaatgcaccgctccgcacgccggcgcacctgcgccgttatggcgggtaggcggctcctccggcgcagtgggcccgggccgcggagacggtctccaggttcttgaatccgcgctatgggccggggcggccttagtgcggccgcaacatgggtcaccagacagacttggctgggccaggggcgaacttccggggcgtgggccaggcgttttcgtccacgccgggggcggggggggcacgttcttgtgctccactgactggagctggaggaggaggacggcggcgggagagcggggcgtcgcggggcccctccccctcagctgtctctcatccctgggtggtcctcgctgtgtgccgccgagggcaagagggttcccagttcagtcgctcagtcgtgtccgactctttgtgaccccatggactgcagcatgccaggcttccctgtccatcaccaactcccggagtacactcaaactcatgtccattgagtcggtgatgccatccaaccagctcatcctctgtcgtccccttctcctcttgccctcaatcttgcccagcatcagggtcttttccagtgagtcctgtttgcatcaggtggccaaagtatcggagtttcattcagcttcagcatcagtccttccaatgaatattcagcactgatttcctctaggatggactggttggatctccttgcagtccaagtgattctcaagatgtcttcaacaccagttcaagatgtcttcaacaccagttcaaaagcatcaattctttggtgctcagttttctttatagtccaactctcacatccatacatgactactggaaaaaccatagccttgactagacctttgttggccatgtaaatatgctgtctaggtttgtcatagcttttcttccaaggagcaaacatcttttaatttcatggctgcagtcaccatctgcagtgattttggagccccacccccccctccccaataaagtctgttactgtttccactgcttccccatctatttgccatgaagtgatgggactggatgccatgatcttagttttgtgaaagtgaagtctctcagttgtgtctaactctttgcaaccccatggactgtagcctgccaggatccttgtccatgggattttccaggtaagaatactggagtgggttgccatttccttctccaggagatctttccaacccgggattgaacccaggtctccctcactgtaggcagacactttactatctgagccaccagggaatgttgagctttaagccaactttttcactctcctctttcacttttataaaaggctctttagttcttcttcactttctgccttaagtgtggtgtcatctgcatatctgaggttattgatatttctcctggcaatcttgattccagcttttgcttcatccagtccagcatttctcatgatgtactctgcatgtaagttaaataagcagggtgacaatatacagccttgacatactttcctgatttggaatcagtttgttgttggaaccagtctgatgtaggtcctcagaagtttccaaatttagcctttatcttctctgccaaaaatgcattcctttccctttgggatggttgtagggtgacagttactaggttcccagatttcttcgttcaataagcgcttagtaaacccgagtggaatttgagcccactcccaagcaagggtgcaaagtggacacccaaaattccggggtaacaagagggaagttcacccttttttggttgaggaaactgaggcagggggagattaagcggttgattcaaggaaacgtgtggattggagtggcaaaattgatatctgaacccaggcagtctcgtggaatcccgttgggagtgcagaggaaaggacaaactgagggactggggagtagggggttaattctgtcaacaagttctgccaagttttcctggagagagtaacaaaaatagctttgctctaagcactttgcctattgtctaataaaagtcttacaagcctataaaagacatgatgtgaccataacaatttcacagatgaagaaacggagacatgaactgattaaactgtccaaggttttaaagccagcaagtgccagagctgagacctgaatctgggtaatctgaacctcgactatcagggcagccactgccatgggttccttttcaaatgacttctgagctctgctgcaaaaagtgagtgggactcagtttatatggatcaactggaaagaactctaaaagcagacgggtgggaaagaaaaccagcaatttgttggaactggcgtttttttagttgccaggttgaatgtggcaaggctgggttcggtgggaattgatgctggagtgacaaagtggagcaggtaccagcagctgtagacctgaaatgctggtaaatattgggcttttctcctattcccccaaagtaaagttggctgctaaccatctgggttggccccaatatactttaagtgatgataataaaacgtacttaattaggggaacctggatattttcccctttgtttttctgtgtcaaagataaaaaaaagcttgacaccattgaagtgtaaaggatggactttattcagtaactatcacaatagggaagagaacccagcatgaaccaagctcgctttgtacagaggtaactgagcattttaaaaggagaaggagggggacttccctgatttgatccctggaccagaaactaggatcccacctgccttgggggaactgagcccatgtgctgcagtaagaggagtctatgtgcctcaacaaagacccagcacagccaaaattaaaaaaaaaaaaaaagataagaaggggttggacagcaggtacttgagcagagtcagtggaaatttataaaaagtgaaggggactgggtcaactgcatctgagtctgtcaatagatgcttacctggaggagaaacaaagttcagcctttatgactggaggcagtggtgcaagttaaagccgttacctccttgaatgctagcatatcaaagagacaaggcggttctgggtggtaaatgatttatacctcaaaggaggagaaaaaggatttataattgaaaggtttctaaagtaaatgctgtagcagggattcaggggctgatttgcctaccaccaggttttggcctgaactcctggccccttaagttttcctaggcaggcaccttaaagcatgccaggatctccttagggatgtaggtagtgtttgttcaagtctctcagtgtggggaggtggatggtatcttttgtgccaagagtcttcagggtttttaggccaaggttgaggtcaattcaagaagagggttcaaaggagcctgaccagggtttggtcaaggagataaatttggtttctaccaaatttagtagaaaccagaagtttctaccagttagtagaaaccttggattcctgtctggatccagacccaaagccgagattttgttgcccgagttgctgctctggttgttgttcagtcactcagtcatgtccagctctctgtgacgccatggactgcagcacaccagtcttctctgtcctgcactgtttcctagagtttgcgcaaactcatgtccattcaatcagtgatgctatccatctgctgctctgggcacgttgattaaaatgttctggagacttcctggtagtccagtggttaagaatatgccttccaaactactctcttcttttgtaaatgtttaacacaatttttcataataaaattaaaaaagaaaaagaatctaccttccaatgaggggacactgatttgatacctgttcggggaactatgatcccacatgccacagggcaactaagcttgcatgccacaactaagactgaatgcaaccaaaataaataaataaatttaaaaaaaatttgtggttcagcatttctgggtttctcatctaaggagagaaactacccttgccatatatgctcttggaatatgggtggctttcctcaacagtgcattgaatgcttctgttagcacagtcacatgcttgttattaggaaacagacctaatgtctttcactctaaagagacaaatcttgtaatccatataagatgctgaagaaggactcctcttttcaattttgtctcagtgctctgagacttgaggctttgttcacaatgccctgtctcggctgagtagacggggagctggggaaggaacagagtataagcaagggggcatgaagcttcatgaggttacaccccatatatctgtcttgctgttgactttcccctctcagcggctctctggaccttaacccgaggtgggcaggccctctgttctggctcctcccactttgtgttggtctccgttataaccctgtcactttatatcatcaggatgttctgactccttctctgtgcctgcctccctctctgctgagtgagttcctccagctcagagaatcacgttcatctgtatactcctggtctaggccattgacccagaaagtgaaagtgaaagtcgctcagtcatgtccaactctttgtgaccccatgtactatacaacccatggaattctccaggcaagaatactggagtgggcagcctttcccttctccaggggatcttcccaatccagggactgaactctgttctcccgcatggcaggcagattctttgccagctgagccacaagggaagccattgacccaagtagacagataataaatggtacttgattgaattaaggaatgaagtcacctaatctgtgaactggggttgcctatccataagtgaaatgttctgacaaggattctgtgatcttcaaggtgccctttggccctgacattctataatatcatgacccccagggtcaaaatattaagcagttaccatctagttcttcaatagacctcagcaattcagccactttccatacgttcatgaaaataaatttcttgaaacacaaataagtaattgtaaaccaagaaaataaattgagtgaaaagaatgagtggtttattaggcagcattttcacatattattattattttctataataacaagaacttctaagttagtcttctgtaaaatttaaaatgttaattaaaaatatgtttctgttataccaggtagttcctaaagattctatctatttggtgtggactctgcccttatgaaatgttggttctgtcttccgacttccaaataagctcaatgccaaggaaacaatacacataaaggaaacctgtggttctgttcatttgtcacttcagactctatattcatgaattaataaataaatgctcctacttcaatctagtgagcaagtgatagatttttgaacctccatttcagaataatacaccttggttacttataaactgagtcagtcaaacatacagaataatgtttcacaagggagactattcaatgctttgttaatttctcctttctatccccactgccactgcccaggcacattacttcaaatttggttttattttcactactgacattgattaaaatgacactgacattgcacagaaaggaaaagaggtcttcaacataaattattgctccacagagcaaacgtgaagcatgagattgaaatgtcctcttagctgatcagctacgggatctcaatgaaaattctcaacacagagtgaggaacttagtgtcttcaaagcatgacaacttggattgactccatggaaccagcatctcttcctatttgcatatcagatgttgactccatgcctccacctctgattaaggagacatcgtgagcgccgctgcacctgtgttctcatggatggtggcccttggttcttctaggttcacaatttgacttctgtacttcccttgccagtcctccacgatgtactggtggtatgggtcattggagtgctctcgtctcttggatttcaccgtgctcaccaggatggctacaatgatgaaagagaacattccgatcatcaccataaggtacaagatgacatagtagaagttctcagcatcaaccttggcttgcagggcctcttgctcaaccgttgtgttcctgcgccagttttccatgtaagtgataaaaatctttttgaagacatattccagtgtctgtgtcagattggatagagttggcatatttccgtcctgctgcaatttaaataaaataggtgaacaagtttaagaaaatgaattctttctctatttggctgccttaaggaatggagggagggccagacaaggttaggtggggggagtaatattatttcttctttacctggctggtgattaagtgcatattttattattctttaaattttgcatgttttatgcaacagtttttcatgcacagtatcttataataaaagtaacataagcacataatagttacagagcatataaaactatatgtattatgatcccaatttgcatacataaataaataatatatgtagaagaaaatgaaaaaagcctggaaataaataagcttaaagtgttaacatggctggtatactcagattttttcttccttatatttttcttaccttcaaaattttcatcgattacccttcatccattactttgtttctaaatagacgggtcacctcacaatagctagcacaatgccttattcataatagatattccacagacatcagctgaagggagcaatgatgatgtatgttctgtgttcttagggaattatggggcagaagtctgcaagggccgtggacagacattgtgatgctctccgtttcctatgtgtaggctgtgatttattccaggtatccctaaggtatgagtatgtccttctgtatttgaacgaagcactttcagtaagtgatacaaaggaacgtgagagattactcatatttcgcaactccatccttgttcccactgcctggccaccagcgtctctcacctggcggacacagtgcagtacaatacaaccctccctaaaaccgcctccccggggtcacatctgcctatctctgcccagtcaatgggctctttttaagagggaaatgggagcatatcgttcccttgttttgaaaacacgcaataccttcctgttgttctccaagtaaaatcctccttcctggcctggccaggccagcccctaaccacatccccaattattcttcccttatggcaactggtcttactggcctggcctgccttcctccatgtcagtaaacattcttctgcatcaggacatttgcacattctattccctcagcctggaatacttttccccttctcttccctctgctaccccctcgacctctggggcccagcttagctgctgcttctgagaaaatatccctggtcctgctctcagccattctcccctcccccagttctctccaatagtgtctttttttgtgttgtttggttgttgttttagttgctaagtcatgtccaactcttttgcgactctatggaaactgcccggctcctctgtccttgggattctccagggaagaatactggagtgggttaccacttccttctccaggggatcttcccaacctaggtatcgaacccccatctcctgcattagcagatgagttctttaccactgagccaccaggtaagcccagtgtctttttacttttcttcaaagcactctctccaatatgtggtaattatgtgtatatgtcattttgtatgtgtgtaattattggcttgtggtctcatgtttcccatcagtcaccacgcctctgtctaccctcgtttagcaaacattggcacagagtctggcacacactgggcacacaatggatgtttgatgagtaaatgaatgtgccaggtatgtgccagcattggaaatgcagcaacagcgaatatgagaattctacctgtggaacctcagtgttgtgggagagatggaaacaaaggagcgtgcgaggtgcaaagcattgtaacaggtgtgaacagagagggtcaaaaagaaatttaacaaagatgtaagattgccctgaagtactcgtcatgcacagtctgtggggtcccaaagagttggacacaactgagtgactgaacaacaacttgccaagcacattttccaagcaatgtgacagaggtatgcttgtcctccttaaaatagcagttcactgtttaagagtgtagctgaactgactttaaccagactcaagacatcatcaccactggcttcttccacctttaagagtccaggtctactcatcggggggacctcacatgtgtctcatgcatcatcagacaaccagcccttcccgtattctctggggctcacctcacaaatgtgatggagcccgactgcttcacccaccagagttctcaccctctggtccttccagccctttcccacagcttcagccaataaagaaaactgatttcccagtgtatacatccccctgccacacccgctagagagaattcggtttcctctggttaagtcaagtagaaaaatggttggaacatagagacaacggggggaaaaaaaccagcaaaacaaacaaaaatcccagaagagctaagtttacgaaataaaaaggctggttggtgggtgatgcgggaagtttagtctgggagaagaccctgagcgactgtggagtaggaggcaactgagaaggggaagaagggacctcttctgggcagagaactggatccccttcatgttttgttgtgttttttgtggttttgttgttgttgttgttgttgagatgagaactattcaagttgtctctgttcattgaagtgctgttctgtgaagtggctccagcatgccctggaccacctgaggcccaccttggaggcccacgtaggatcggggttcccccagagaggtggtcacattacaagctcctccaagcactgagctccttggcctacccgccttccatgagtctcctttgtgggctgtgtctctgtgcctgtaattcctgtctcctccaggcggaggcagtagagtcccagtgtcacatggaagggacggtaatgtcagtcacgctcactgccaacactgttctgtgaatgttttcatcaaagcaactcctaagttcttcaccacctatgaacactccaggccagagcctgactcataagaagagttcagtcattagccccctgttccttcagggctccgagggaacatagtggtcacaggagaggcgtgttttgatgtttagcaaggccatccaggatggggtgcctcaagggaatgaggatggggcactttgaatcttgaggggaggatcactgcagaggaaggaagaaatacagctccactacaggagggagctgggacacattttattcacacattttattttattttatttttctaagatgtatttagtttggggctgtggtgggtcttttggctacatgcagactttctctagttgtggtgagtgggggctactcttcggtgcaatgctcaagcttctactgcggtggcttctcttgttgcagagcatgggctcgaggtgaatgggcttcaatcgttgcagcatatgggctcggtggtttcaccttgtgggctctagactgctggctcagtaagttgtggtttagttgctccacagcatgtgggatcttcccagaccagggattgaaccggtgtcccttgcattgcaagatggattcttaaccactggaccaccaggaaagcccaagattcacacatggtaaaaaggtggtttgctcttgtagtttcaggaacctaggtcagtagtcaccccaacacaagcatttccctaagctcctggtcatgtttgcttgcttgcttagtttcaatttcctgttcattgtgtgctattcacaggatgatcaaaacctctcttaaatgtagacaattacctccttctccaggaggcagtgatcaagaccatccccaagaaaagaaatgcaaaaaagcaaaatggttgtctgaggaggccttacaaatagctataaaaagaagagaattgaaaggcaaaggagaaaaggaaagatatacccatttaaatgcagagatccaaagaatagcaaggagagataagaaagccttcctcagtgatcaatgcaaagaaacagaggaaaacaatagaatgggagagactagagatctcatcaagacaattagagatatcaagggaacatttcatgcaaagatgggctcaataaaggacaaaaatggtatggacctaacagaagcataagacattaagaagaggtggcaagaatacacagaactagaaaaaaaaaaaatatcctcacaacccagataatcatgatggtgtgatcactcacttagagccagacatcctgaaattcgaagtcaagtgggccttaggaagcatcactacaaacaaagctagtggaggtgatgaaattccagttgagctatttcaaatcctaaaagatgatgctgtgaaagtgctgcactcaatatgtcagcaaatttggaaaactcagcaatggccacaggactggaaaagtcagttttcattccaatcccaaagaaaggcaatgacaaagaatgctcaaactaccacacaattgcactcatctcacacactagcaaagtaatgctcagaattctccaaaccaggctttcacagtacatgaaccaaaaacttccagatgttcaagctgtatttagaaaaggcagaagaaccagagatcaaattgccaacatctgttggaacacagaaaaagcaagagagttccagaaaaatgtctacttctgctttactgactatgccaaagcctttgactgtgtagatcacaacaaactgtgggaaattcttcaagaggtgggaatactagaccacctgaactgcctcctgaaaaatctgtatgcaggtcaagaagcaacagttagaactggacatggaacaacagactggttccaaatcaggaaaggagtacatcaaggctgtatattgtcacctgcttatttaacttatatgcagagtacatcatgagaaatgctggactggatgaagcacagctggaatcaagatttctgggagaaatatcaataacctcagatacacatatgacaccacccttatggcagaaagtgaagaagaactaaagagcatcttgatgaaagtgaaagaagagagtgaaaaagttggcttaaagctcaacattcagaaaactaagattatggcatccagtcccatcacttcatggcaaacagatggggaaacagtgacagactttatttttgggggctccaaaatcactgcagatggtgactgcagccatgaaattaaaagatgcttgttcctcagaagaaaagttataaccaacctagacagcatattataaagcagagaaattactttgccaacaaaggtccatctagtcaaggctatggtttttccagtagtcatgtatggatgtaagagttggactataaagaaagctgagtgctgaagaactgatgcttttgaactgtggtgttggagaagactcttgagagtcccttggactgcaaagagatccaaccagtccatcctaaaggaaatcagtcctgggtgttcattggaaggactgatgttgaagctgaaactccaatactttagccacctgatgcgaagggctgactcattggaaaagaccctgatgctgggaaagattgagggcagaaggagaaggggtcaacagaggatgagatggttggatggcatcaccgacttgatggagatgagtttgggtaaactccgggagttggtgatggacagggaagcctggcatgctgcagtccatggggttgcaaagtgtcagacatggctaagcaactgaactgaattgaatctgttttacaaatgaggaaactgatgtttagagaataaatcctttggtttcaaaagacaagagaatggagctgctggagggcagggatcattttatgcatctttgaatccctgggcctgcacaggggttgttgggtgaagtgaaagtcaatcatgtccaactctttgtgactccatggactgtagcccgccaggctccactgcctgtgggattctccagacaagaatactgcagggggttgctatgcccttctccagggaatcttcccaaccagggattgaatccaggtctcctgcattggaggcagattctttatcatgtgagcccctaggaaagcccggggttggtgaggagcagacttttattactcattcattcacctgtgttctgcagatttcaacatgaaactacaatagtgattcttaaattatttgtgggaggggaggggtagggagggtccccagattccttgaaaaacaaaattgaaaaatatgactatttttccccagaaaagtatatgtatgcagacacaaagctctacattcacttttgggggactcctgggcccctgaaacccaaccaagaatctttgctacaaagtagctttgagatgaaggagttcggagttcagagttcccctggagttggctttgtttctgggtgtggacaaagctgcactgaccggcctcttagagctaatactgctgattatttgttcagctcttttatatggacagaggccattgataagcagatcaggaggtgctttttaagcacagagctgaaaagggcctctggggataaaatgcctcagtgctgacccctggccagactgaaaaagtcaaggccaaggaggattcactatttagacgctgtttcatgagacatggctgggcaactcatcccatacccacaggcaaaaaccaaatcatggtgtgtgaaagctgtttcattgatggacattctgctgaaacaaacagattaacatttctgatatccagaataactatttaactgatagacgttgaccacatttagtataaacagtttttcctcctctaagttgaatatcataataggcattcaccttaggaaggaatggagaggccactattatttacatcctgttgaaccatttgaagttgccatttatagaggttaaaaattgtcggatattggcaaggtcatacagtttaatacaaattggtctacattttcaggcattcttaatagatggttcttgctcagtcaaaaaaaacgatgggtccctagagattcttggagcttgtctgctgctttggggagagagtaactatagcccgagacaagcccttggaatcccctgtccaaggtcacagtgctgagtctcgaaacccaactcacccaggctggcacccagcccctactttgtcctagaagaggtcacgaagtccagaaactccctgtttccatcgcctgcaaccagtcagctcactgggcaaaaagaaatgagaccaagatccaagcttgactccacacacatcagtgggttgagccctatcttcaggacacataataacccctaaactgtcacacaatgaaagtgtcaatggctcagtcgtgtctgactctttgtgaccccataggctgtagcccactaggctcctctgtccattggattttccaggcaagaatactggagtgggttgccattcccttctccaggggatcttcctgacccagggattgaacccaggtctcctacaactcaggcagattctgtactgtctgagttgccaggggagcccctgtcataaatgtgcataattcatgacaaggacaaagggacactatgaggaaagccacatgcccttgattctcaaacccaaactctctttcccacaaagactgtggctcaccagtatcatccggacctaaaggcagtagtctttcccttttataacaggaatagaaaaagaagagtatctgcatttaccatgaaacttccatttagaaaattaaatattcagggacttccctcgtggtccagtggctaagacttcaccctctcagtgcagagggcccacattcgtttcctggtcagggaactagatcccacatatggcaactagggcctggtgcaattaattaaataaaatattaaaaaaaaataaagaaacacacattcaaagtgcccgggcaaaggcaactactgaagaaacaagtacagaaagccctacagaaagaagaaggaggaaaaagagggaaaggagaagaagaaaatacaggaggaaggggaggaagagagagagaagagagagagagagcaaaagggtgcagaaaaggaaggaaggaagaaagcgaggaaggaaagcagaaaggaaggaaaggccaggtcttgtactgggaaaatcattcctttcatcattttctggtgaaaaaaatagctttgttacttaattcctcaaacaataaagaatttgtgatggaaacttgcctgtgtggtgtgtgagtggtagggaaatcttcactgcaccttcctgctggcttggggaacttccagagtgctgcataaatctggcctgtgtgcagcttcagcctgtagtcagccgagccctcgctgactgctgtctgcagtcctagatgtttatgaacccaaatatttaatctaatcttatgtggaaagtcaaataccgaccagcagttgggaattcaccttggtgtctggaaggggtgtgcctgggtggagtctggccttgggcacaagttcccctcctccagccccatgatgccagctccagtcggggtaccgggagcctcccttcccggggcaaatctcagtggacagcacccttccctgcagacctcatgaggagggaatatgtcccagagagctgacgtgaatatggccatgggtggttggtgtgggttgagtcctgaatattcatcggaaggactgatgctgaagccgaaactccactacactggccacctaatgtgaagacctgactccttggaaaagaccctgatgctgggaaagattgaaggcgggaggagaaggggacgacagaggatgagatagctggatggcatcaccaactcaatggacatgagtttgaacaagctccaagagttggtgatggacagggaggcctggcatgctgcagtccatggggttgcaaagagttggacacaactgagcgactgaactgaactgaagtgagaagacgatcagtatatttcaaggcaggaccgcctattctgaccacctcctcataagccaaattttgttaaatactgtgggtttccctggtggctcagctggtaaagaacctgcctgcaatggggagacctgggttcgatccctgggttgggaagatcccctggaaaagggaagggctacttactccagtattctggcctgcagaattccatagactgtatagtccacagggttgcaaacagtcagacccaactgagcgactctcacttcacttcatttcacctctctctgggaacaatttccaaatgaattataacaacactgttgtctggtaaaatagaaactggtcacaaaaggtgttatatggaggaaatggaagcaagtctgcaaagaataagaaaaattaaataaactcttcttattaaatgatcctttctacggtagttggagacactggaactgagcagagtgggacttcacagaagctgacacactcaagtgcttaccacgtgccaagctcttccccaatgcttttattgtatcagtatcatgtgattgtttccacaacccagtgtgagaagtgccgtgaacttgacaactagggaatccaggcacagtaaggtcaacaggtcaggaggaaatagaagtagggccggggaagtcgccctggcggtccaggggttaagagtccacctcgtaatggaggggatgcaagctcgattcccgatgctgtaaactgattccacgtgccacagagcaactaagccctcaagccacgactagagagtctgtgttgttgttgtttagttgctaagtcgtgtccaactctttggtgaccccaaggactgtagcccaccaggctcctctgtccatgggattttccaggcaagaatactggactgagttaccatttccttctccaggggatctttccaactcaggaatcaaactcacatctcctgagtctcctgcatcggcaggcagattctttagcactgagtcacctgggaaactctgtggggcacacaaaaaaatgtctcccaagacgcaggaagattctttgtcccacagctgaggcccgacacaaccaaatgagtaaattttaaaagtaagtttttgcctgtttgtttttaaagaagtagagtcagggtttgagtctggttgttgaatggtggctgcagaagttacactccaccaaagtcacttgagtcacaggactggtcattattcagtaatgttccagtgtaaaggaacattaactctgtttcatcttggattttctcattacgtggtactctgaacaataaggattgcagtactctggctggcaagtggaagagggctggggtttaaaatgacctacaaagtaccgtggccacttgatgtgaagagccggctcattagaaaagaccctgatgctgggaaagatagaaggcaggaggagaaggggaccacaaaggatgagatggttggatggcatcactgactcgatggacatgagtttgagcaaactccaggagatggtggaggacagaagaacctggcgtgctgcagtccatggggtcacagacagttggacactgaacaacagcaacaaccaagtaccatagctaatgtgttagatgtgatctgaagaaattcaaattcagactgaaattgaagaaagtggagaaaaccactagaccattcaggtatgacctaaatcaaatcccttatgattatacagtggaagtgagaagtagatttaagggactagatctgatagacagagtgcctgatgaactatggacagaggttagtgacattgtacaggagacaggaatcaagaccatccccatggaaaagaaatgcaaaaaagcaaaatggctgtccgaggaggccttacaaatagctgtgaaaagaagggaaacgaaaagcaaaggggaaaaggaaagatatacccatttgaatgaagagttccaaagaatagcaaggagagataagaaagccttcctcagccatcaatgcaaagaaatagaggaaaacaatagaatgggaaagactagagatctcttcaagaaaattagagataccaagggaacatttcatgcaaagatgggcttgataaaggacagaaatggtagggacctaacagaagcagaagatattaagaagaggtggcaagaatacacagaagaactgtacaaaaaaggtcttcatgacccagataatcacgatggtgtgatcactcacctagaaccatacatcctggaatgtgaagtcaagtgggccttaggaagcatcactacgaccaaagctagtggaggtgacggaaatccagtcgagctatttcaaatcctaaaagatgatgctgtgaaagtgctgcactcaatatgtcagcaaatttggaaaactcagcagtggccacaggactggaaaaggtcagtttcattacaatcccaaagaaaggtaatgccaaagaatgctcaaactactgcacaattgcactcatctcacacgctattaaaataatgcttaaaattctccaagccaggcttcagcaatacatgaaccttgaacttccagatgttcaagctggttttagaaaagtcagaggaaccagagatcaaattgccaacttctgttggaacatggaaaaagcaagagagttccagaaaaacatctatttctgctttattgactacaccaaagcctttgactgtgtggatcacaataaactgtggaaaattctgaaagagatgggaatatcagaccacctgacctgcctctttagaaatctgcatacaggtcaggaagcaaaagttagaactggacatggaacaacagactggttccaaataggaaaaggagtacgttaaggccgtatactgtcaccctatttatttaacttatatgcatagtacctcatgagaaacactgggctggagggagcacaagctggaatcaagattgctgggagaaatatcaataacctcagatacacatatgacaccacccttatggcagaaagtgaagaagaactaaagagcctcttgatgaaagtgaagaggagagtgaaaaagttggcttaaagctcaacattcagaaaactaagatcatggcccatccggtcccatcacttcatggcaaataaatggggaaatagtagaaacagtggctgagtttatttttctgggctccaaaatcactgcagatggtgctcacagccatgaaattaaagatgcttactgcttggaaggaaagttatgactaacttagacagcatattaaaaagcagagacattactttgccaacaaaggtccatctatgaaggctatttttttttttcccgtagtcatgtgtggatgtgagagttggaccataaaaaaagctgagtgcagaagaattgatgcttttgaactgtggtgttggagaagactcttgagagtcccttggactgcaaagagatccaaccagtccatcctaaaggaaataagtcctgggtgttcattggaaggactgatgctgaagctgaaactccaatactttggccacctgatgcgaaatgctgactcattggaaaagactgatgctgggagggattgggggcaggaggagaaggggacaacagaggatgagatggctggatggcatcaccgacacaatggagatgcgtttgggtaaactccgggagttggtgatggacagggaggcctggcgtgctgcagtccacggggtccaaagagtcggacacaactgagtgactgaactgaactgagctgaagaaatacaaggatttctaaaactctgcaccagcttcttatgacaccattagatctctaaagttgccttctctgaacaagacaaggccaactccaccggaaaggatggatctgatggccccattggactgagagtgccttcatagaaacagaagcaggacatttaaatgtctccctgggaaattccactgaaaggactgtgccccctgctggtgaaacaaggaacagatgctgatctccctcctcaggcagccctggtggtttaactttcagttcagttcggctcagttcagcctcagtttagttcagttcagtgttcgactctttgcgacccccatggactgcagcacaccaggccttcttgtccatcaccaactctcagagcttactcaaactcatgtccattgagtcagtgatgtcatccaaccatctcaacctctgtcatccccttctcctcccgccttcaatctttcccagcatcagggtcttttccaatgagtcagcttttctcatcaggtggccaaagtattggagcttcagcttcagcatcagtttaaccttataacttgaattttcctggtgcagagctaagaagaatcaaaagagtgagtgagtctacactttggtaattggagcaagactggaaggtgatatatcctggaggctaagagcttggctttggaggctgacaaacctggagagcaaagtacatagtgttcctgatctgtggattcttcagctgcaagatggaaaggagtttctatctcactgggttgtcataaaaatgagacgagataaagaacataaagcacttagtacagccctggcacataagaagacagtaagtgccttacacacgttaacttttgctgttatttttcagagaaataaaaagaagatgtggcagtgagaagcacaacttgccagccttattatgagaagggtagctctttttttgtttttaattgaggaatagccaattaacaatgttgcaatcgtttcaggtggacagcaaagggactcaccatccatacgcatgtatccattctcccccagactcccctccctccaggctgccacacaacatgagcagacttccctgtgctgtacagtacatccttgttggttatccactttaaatatactcatagcagtgtgtatatgcttatcccaaactccctaactatcccttcctcccatccatcccccaggcaaccacaaattcattctctatgtctgcgattctgttttgtaagtaagggacttccccagtggctcagatggtaaagaatctgcctgcagtgcaggagacccaggttcgatccctgacttgggaagatcccctggagaaggaaatgacaacccactccagtattcttgcctggagaattccatggacagaagagcccggcaggctacagtccgtggggtcataaagagtcggacatgactgagcaactcacactttcactttctttgaagtatctgttacaagctggagaagaaagtggaagggggacagagctgtctcctgtttcccttgatggacatcagccttcttgacctctgcagaagactctcgatagacttgctctgccttgtccccaacaataaaatgctacctgcccagaaagcaagggacatgaaagtaaatattctctttgaaaactacattgcagtccacatcttcacatacagctttacttacccctgcctacacagggcatgtttttaaaatctagagagctgaatctgcttttggatttaaaattcagtctgacatccagcactaacaaaacccaacattcctttgaaagagaagagcgtagaagactttgtttagaactgagtctgcctttcaactatagaaactcagataataagttggttacaatagagttatggaatatttggaaaacttgaacatcaaatctagtgaatctcatacatgcaaaatagcactgcgtgtgcgtgtttagttcctaagttgtatccgactctttatgacccatggactgtagtctgccaggctcccctgtccataggatttcccaggcaagaatactgaaatgagttgccatttccttctccagaggatcttcccaacccagggatcgaacccacagctcttgtcatgtctcccgcattgcaggtgaattctttaccactgagccaccagagaaaccctataaaatagcagtgctgctactgctgctgctgagtcgcttcagtcgtgtccgactctgtgcgaccccatagacagcagcccaccaggctcccccgtccctgggattttcaaggcaagaacactggagtgggttgccatttccttctccaatgcatgaaagtgaagtcgctcagttgtgtccaattcttagcgaccccatggacttcagcctaccaggctcctttgtccacgggattttccgggcaaaagtactggagtggggtgccactgccttctccgataaaatagcagtatgctagcttaaatacttataagaacttaacgctgacccttctttcaagtctattggattttatttttatcccaaatatcaatgagatgaaacaaatttaatacctggaataaatgcataggcttaaaaccattttgtcctgaaatatctaaataacttatgcaaataaaagtacgttggcttgtttgtttagcttgaactgaatagctgcttcagttttccttttcagcatttatatataagctgtcccataagacagttactgaactcagaatatggctgatctgaatcgaaatgtgctataagtatataatacaaaccaaattttgaagacttctgacaaataatgcagaacatcttattaataatttttatattaatgtgttataaaaatgataatattttagatatattagtttgcattaaatgtattgctaaaatttttaataattttattattttttttatttcattttttggctgtgctgggtctttattgctgctcaggctttttcccggttgcggaaaaagagttgcagtggcttctcattgcggtggcttctcttgtggtggaacacgggctttagggcatgtggtggtggtttagtcgctaagtcgtgtctgactctcgtaaccccatgaactgtagccctccaggctcctctgtccatgggatttccaggcaagaatactggagtgggttgccatttcctcctccaggggaatctttccaacccaggaactgaacctggatctcttgcattgcaggcaggttctttaccaactgagccaccagggaagccctctttttcgtggcatgtggggctttgttgctccatggtacgtggtatcttctcagaccagggatcaaaccctgatttgatcaaactctgatttgtctcctgcattggcaggcatattcttttccactgagccaccagggaagccccaaatatattgataaaatttaaaaaaattaaaaaagaattgtctgcctttcaagatccctgcagtgttcttcaggcaccactatggatacaaactcagaggctaccaccacttcttaagaagaacataactctgatgacagatgatggggaaggtagagggttgctaattgtctttggagaatcgcagatcagtcagtctctgcctcagtcctgtgaggagagataccctgcacagcctgcctctgttgtcttcctgtgatggccggggctgtacctccacacttgccttcctcacaccctccaaatgcagttacgtcatgtgcgtgccaagtcacttcagtagagtccaactctctgcgaccctatggactgtagcccaccaggcttctctgtccatgggattctccaggtaagaatactggagtgggttgccatttcctcctccagggaatcttcccaacctagggatctaacccatgtgtcttacatctcctgcattggcaggtgggttctttaccactagcaccacctgggaagttagttacatcacaatttagggttaaatccaatctcagagtttgcatttctatggtaatagaaaccttgttccttgatgactcacactgtgagctgtaattacatctttgctgtacaagttttcccccctccccttggagttaatcattatttcttttcttttttttttttttaatctacccttgaacttcttcctatacccttcagtggctcaacatcattagtcagcctggaaatgaacttacgagcacagtgagatgccaccactcatatactagaatggctaagctttaaataagactgacaacaccgattgttggtgaggctgaggagtgactggaactttcctcattgctggtgggaatggaaaatgatacaaccacttggaaacagtttggtagtttctgaataacttagctaaagggccccagtaggaacgtccccggtggtccagtggctaagattccacacagtgcaggggcccaggttcaatccctggtcaaggaactagatgccatatactgcaattaaaaacgatcccacatgccacaactaagactggcacagccaaatcaattaattttttaaaaaggcctcaacaatttccacttctatgcatttacccaagataaatgaaaaagtatgtccacacaaagacttacagatgaatgtttatagcaattacattcataatataaacactgggaataacccacatatccttcaacagacaaacaagtaaacaaattgtggtctatctatacaatagaatattgctcaaaaataaaaaggaacaaaccaatgatacatgcaaccacatggatgaatctcaaaaacattatctgagcaaaacatgtcagacaaaaaaggagttttactgtgtaagtccatttctagaaattccagaaagggcaaaagtaatccatagtgatagaaagcagatcagttgtttcctggggccaagtgaggagaggcatgaaagcaaaggatgaagagagaacttttgcgggtgactgaattgttctgtatcttgattgtggtggtggttactcaagtgtacacatttgtcatacaactgtacacttgaaatgggtatgtgtaatgtgatgtaaactataccacatttaagttgatatcttaaaaatccatatttataaatttatgtctccagcccaattttctcctctgaacttcagtctcaaatgtccagatgctttcttgacatttctgcctgcttgtctgatgacatctggccttaaaggtccaaacagaacgcttacttctccaccagatctgctcctccaccatcacagtaaaggtacactcaccatcctctcagttccttaagcaaaaaacccaagaataagctttgattcctttcttttcctcacctcccatatccaatccatcagcagatactgtagattcactcctgtcaagaaaaatctctccaagtcttgagcttggatgtgtacgtgtgacctctggggagcactgaccccaccagaactgtggcaacccaacttcacttcattggaaactgcgtctgggcttttgtgttgtaactggtgtgatggccaactgcaaagaagagttgcagtccatctcaggcaccaactggacacctgttctcagaaacttgtcctcttctattgtaattttttttctattgttaccctaagctttgttcttcctatttctgcacaggcagaccttttgatcatgtccttttgtctggcaaagctatagatccagctttatttcttactgcttttgtggtttcatgttttaatctgacacttcaaaacacatcccaactcagtctactttgaaccacccgccttgtggttttgtcatggcttgctctctgccttcagccttcttctgctctttgtcctctttcatccaggtctaagagcaaccagcatgaccttttagaaacatagatcagaacatgctattgccctgtgtaaaactctccactggtttcccatcacctttgaagtaaaagtcagactccttagtgcagcctgcaagccagtgcaggacctctggtcccctctctgatctcacctgccccttgtaacctgattgtgcttccctgctctggtttccgccttagcgtctgtattagtttctcactgttgctgcaaaaaacggtcacaaacttagtggcttaaagcaacacatatttattatctctaagttctggaggtcagaagtccaaaatgggtctcactgggttaaagtcaaggtgtcagtagggctgattccttctggagattctgtgggtttggacctgtttccttgtcttttccagcttctagagactgcctacattccttggctcatggcctcttcttcatgtcactccaacctctgcttcatcctcacatttcttaccactcaccctgaccttcttgcctgtctcttataaggacctttgtgattgcacctagcctgtgcaaataatccagaataatctcacctcaaggcttttcacttactcacagctgcaacatcccttctgccatgtaagttacctttttcataggttccaaggatcaggagctgggcatctttgaggggccatcatttggcctgctacaacatctctgcatcagctgttccctctgcctggaacaatattcctgcagatcttagtatggcttgcttcttgctcacttcaaatgacatattctcagacaagtttattcccctgctcaccaggtctgtaacatggacgcccagcccagtcatcagtcactcagaacaattttaaattatctgaattgtgtagggctgccccatcctgttccatacactgtcagtgcacaaccaggggacacccttcactcagagtgttagaggaatttgtgcacagactgtaccaccttgcatgatggcatctctgaattctgaagtgaccctgttttattgatccccatgcccagtctctaactagaacttgagttccatgacaggaatcttgtctgtaatttctcattctgagtctggttgaacaaaagctctccgtgctttccagattcatgggtgtgctaagcccctcagttgtgcctgactcgtgaccccatggactgtagtccaccaggctcctctgtccatgggaattctccaggcaagaatactggagtgcattgccacttcctcctccagggcatcttcctgacccagggatcaaaactaggtctcctgcagttcctgcaaggtaataaagctgtcctttcccacttcacccaaatctctgtctctgagattccattcagcacccctgtagctagaaactgagctttcggtatcatttcctcccctgtgctaatctggaatgaacgattgccttactgtgataccagggttattttacaaagacaattttcaaagcggaggagaatcaaaacaaagaaaaaagaatcctcaacatgcgggccacaggtgtgcaggcgactgaaactggatggaaagtggagaaaggagaaccatgggggctttgtctcccctagaagtactgggaggccttggacccttgtagggaaaagcaaatcaaccccaaaggggaacagagaagaagattctcatgagcaaactttgtcttgctttccagttttgccaggaatcagacctgccttttggtctctacttagcccccagcttcccgtgaatgtacccggtgcaatgcttcccagatgtgtccctgacaacgtctctccttagtcctgactgcttcgtttaggcagattgttgtgtgggttttctttggaactttcgtgtctgattcaaagacagaagcttgggatggggagtgtccggggctggaagagacccccagatgccccagcaaccccacctaggccccatcactgtgcacacccagcccttctgccctcctgatgcactcagattggatctcaaggagggacatccaccaaactcaagtacccactctcttaagaagtgatttgtaaggattccatctccttgaacatttagaacaagtccttgccttgtctgggagaaaactgcctttaggactctcctagattccaaagtgtgtagcttgaagaatctgcttcacttcacacatgttattattattttttttttttaagacaacaagtgttggagaggatgtggagagactggaatccctgaacactgttggtggaaatgcagaatggccatgtccctatagacaacagtacagaggcccccaaaaaattaaatctagaactaccacgtgatctagtgaccccagccctgggtatgtatccagacgagtccaaatcaagatcttgaagagatatctgcacccccaatgttcatctcagcactgttcacaagagccaggacatggaaacaaactaagtgcccttcagtggataaatggatgaagaccatgtggtagaacctataatggaatactatacagcctttacaaagaaggaaattctgtgatatgtcaaaacacaaaggaacctgagggcatcatgctgacggaaattcaccagtcacagaaagacaaacaccgcatgcttccacttatgtgagacacctgaaatagtcgaattcatagaatcaaaaagtggaatggtggttgcaggggctggggggattgtaaatgggaaattactaatcactaggcataaactttcagtcaagtaagatgaacaagctctagagatctgctctacgacattgcacctagagtcaacaataatgtacacttaaaaaaattttttaaagggtaaatctcctgttaaatgttcttacaacaataaaattaaattaaaagaaaaagaatttgcttcagattagcaacctcaatggcaccccactccagtacttttgcctagaaaatcccatggacggaggggcctggtaggctgcagtccatggggtcgctagactcggacacgactgagcgacttcactttcacttttcactttcacttttcactttcatgcattggagaaggaaatggcaacccactccagtgttcttgcctggagaatcccagggtcgggaagcctggtgggctgccatctatggggtcgcacagaatcagacacaactgaagcgacgcagcagcagcagcagcaacctcaaggagacagaacagctttatgggtatccagaagagagatggcccagagggatgactcctgctgtctggagaataactgaccacctctttcttgccgatggtctttcagacctgactaggcatggtgtttattataggttctcctcggctcaggctagggaaagcaaatctaaaccagaggttgtggtgctcaaaacgaccacactgtgtccccacagcactgtcaggcgtgcctggctcacagagccacatggcccagccgtggtcagcgctgggcatcagagatgcactgtgctttaggtggtgggcctccctcctgctggatctcacagccagtagccctgaacaaggtctgggcttatttatttattcatttttatattagacagtgatggatacaactgttctatacatttccttttttatcatttttattttgaaatcactgtagagtcagaagacgttgcaaacacgttgagtcccatgtacccttcactcagctctcctcagtaaatgacatcttataaaactatgatgaaatatcaaaaccagggaatctataccaatacaacgctgttaactagaccacaagccttattcagatttcactgtttttaccgacattcatctctgtgtgcttgttgctgttgttcagttatcaagttgtgtccgactctttgcaatcccatggactgcagcatgccaggcctccctgtccctcaccgtctcctggaaaacgcccaggttcatgtccattgaattgatgtgtgtgtatagtttggtgcaattttcctctaatgtgtagattcatgaaactaccaccaccaaggtacagaactgccccacccccatctcacctctaagaaagcctctgtgtgctcagtcgagtccactctttgcgaccccttggactgcagcccgccaagctcctctgtccatgggatttcccaagcaagaacattggagcgggttgccatttcaacctccaggggatctttctgacccaggaatcgaacctgtgtttcctgtggttcccacattggcgggcagagtctttactactagcgccatctggaaagatcaagaaaccccatttacaatcccctttacacttgcacccctctctcccacactctatcttctgttttcaccctctacaaacgtgtcattttgagaatgttttgtaaataggatcatacgtaaacaaccttctgagaatggatttttcccacttggcataatgtccctgtggtccatccacgttgctgtgtatgtctatagctagtttctttgtgtttctgagtagtattccattctagcgatgtttcacctttcacttgctgaaggacatttgaattgttttcagttttctgctatggcaaacagagttactatgaacattcatgtacagatttggatgcgaacctaagttttcatttctccaagattaatgttcaagagctcaatttctgggtcatactgttgctgttcagtccataagccatgggcccccagggactgcagcacgccaggtttccctgtccttcactatctcccagagtttgctcacatttatgtccattgagttggtgatgctatctcaccatctcattctctgctgcccccttctccttttaacttcagtctttcccagcatcagagtctttcccagcatcagaggcttttccagcatcagagtcttttccatgactcagctctttgcatcaggtggtcaaagtattggagtttcagcttcagcatcagtccttccaatgaatattcaggactggtctcctttaggatggactggttggatccccttgctctccaagggactctcaagagtcttctacaacaccacagttcaaaagcatcaattcttcagcgctcagctttcttaatggtccaactctcacatctgtacttgactactggaaaatccgtagctttgactctacagacttttgttggcaaagtgatgtctttgctttttaaacactgtctgggtttgtcatagctttcttttcaagctgggtcatggggcagatgcttatttagttttctaagacactgctaaattagtttccagagttgctataccagtttacattccagccaggaaggagtgaaaaattccagtttctccatatcctcaccaggacagctttgtgtttgtatccatggtaatgaaccctgggtagaacgttaagaccatatggggtcttaaagatcttccagtccagcacagagagcaatcaagacacagagaagggtcccgaccatcatttccactttctccaattctccccttaccaccgtcttccctgtttgccccaacgaccgtctcaggcagagctgtctcatctcttatggctctgtgaatttgtcaaaatttgggcaggacctaagagtggtgttcaagcctcggggcaaagtcttgctcaggaagttcaacctcgcacttagctgtcattgaagaaaccaggctctggctgctcttgtggtttcctgcacagatctaatggaccattgcatccctttctctcaagaaatcactaacaataccaaagttcaaatactgtcgaaaattgtagcccaccggccagctttcccaggttcaccctacccctgcccaacaataatgtcaaagccattgccactagctcggctgcccctagttattgagcacctgctgtatgcccaacctgcaagccccatctgagacttgacagatgaggaagagatgacgaccggaagtcataatcttggactccaaaagtttaattcttcacatatattagctcgtttgaggttcacaataatcccatgaaatgggtttcatcgttgccccagctatacagataagaaaccccaggcacaaggcattgaattcacatgctcaagtcgcttgcatcgtaaaggaaggatgaggtcttcctgtagagcacagggaacaatattcactatcctgtgatgaatcatatgtgtgtgtgttcagtcatgtctgactgtgaccccatggactgtagccctccaggctcctctgtccatgaggttctccaggcaagaacactggagtgggttgccattgccttccccaggaatcttcccagcccagatatcacacccacatctcttgtgtctcctgcatcggcaggtgggttctttagcactgcgccacctaggaagcccagtgataaatcataatgaaaaagaatatgaaacaggactcacatgtatgtataactgaatcaccttgttgtacaccagaaaccaacaccatgttgtagatcaattgcacttcaattttttaagaaacttaaaaaaaaaaaaaaaaaaaaaaacaatataaaagataaaaaggcttcagagatcattttccatcagactcaagttttataatgaaagaaccaggtccatatcattcttctgcacaactgctcacggtgcaaaaacgcatgaaataatgttttcgatgaccttagggactttttctgtcactttctgagcttaaatgagcaatatgcctccctcttatttaggtgagtgccaccaggtggcgccaaagctgagctttttcatcccgtggaccagcgggacttgtctccctggatggtcactgattctgacatcctgctgcttcccactcagcgacagcatctctaacacattaaactcttttattaaacgagcagacacctttgcttccttaaaaatcaaatcactaaatattaacacccacccacctttctaaaagggttacactttacagaaaaaactaaagaaataaaatgcctaggcagaaaatagaacctttacactaaacattaattgctttaaattcctgcttattgtagcttcaggttttccttgtataaatgctcctgaaacataggcaactgttccagacatacacaacattttcagtgactcaaagtcctgatttctctgcccttctctgcagagatgaaacaaaaggctacctgtagctttgtttcggagaaggcaatggcaacccactccagtactcttgcctggaaaatcccatggacagaggagcctgttaggctgcagtccatggggtcgcgaagagctggacacgactgagcgacttcactttcccttttcactttcatgcattggagaaggaaatggcaacccactccagtgttcctgcctggagaatccctgggacaggggagcctggtgggctgacatctatggggtcacacagggtcggacacgactgaagcgacttcgcagcagcagcagcagctttgtttactgtggagcttgtttgagaatattttaagaactgaagctctcttgttttgcttgtccgtgcccatttccccataacctactaatttccctgtgtctttctatgtgggtaaattgttttctgcctctttgttctcctaaacatgaaaggagagacacaactgctgtatatatactgtgtgtctcaatgacctctggtttttcctcgcatttccccccagtttaggtatttcatcgatgggagcttttcttcttcctgtttctctttccttcaaagttttgagcaggaggagcaatttgtgctggtttgcctgggaattgctttccatcctgccccctaagttccaggctgaaagggacagcttgtgactctagctttaagtctgaggaaaagtaaacttgcaatgaaattaagattagcattcaattccagccactgtagcaggcttcattctcagtcacagacctgttgttcactcatctgttcacttattcattcagcagacacgtatgtgttaagtaaaactcgactccctttgccagtccaaatccatctacgtgactcttcatgttcccacctttcgctgatgttgtctgatgccgacggtgtgtgttagacgtcttctaaggctcacagtgctgaatgcagcatctaatctgaatagatgcttcctaaatggttgttcaatgaaggaaaaggaagaacgcccctctcccccttgaggctaccacttctccgtggctccaagcctatcttcattctagaatcttctcagcccctgcttgaagctgaagaacattcctaggcaggggtagcaaaggggacgttgtgatgtcacatggggtcttggccctgatagaaacagtgctgtccaacagcttttagaacctgcttcaagcttcataatcccttgttatccttccgagaataacaactccccaaatttgttttgcgtgaggttgatatttatatttgtgagaagctagtatttacgagggactcataactcaggagcagccttcattccataccagacctcaacatttcagaagaggaggtagtggttgcagaaacgggagagaggaatttgcctgagagattgtctcctgttcccaaataagttccgtctccctttcccagccagactctctataaaagggaaaactggacaacaggcagtgggaaaggagcatgtcctggcaactttctgtgagacgcgtacgccacgctgtttacaaattcctgcagccagccccggagtccaaatgtagacaactctgtttatgtaactaaaatagacgcttataccgtgtgattaggtggccacggtctggagacatttgctgcagctgagaccagaggggagcacagggcacagtgtcccctgggaccctgggcaggtgtggggttttttttttttttttttaagatgagttttcgggtctagaaatctcccagggtggtcacgtctaaaatgcagggcaggagtcataagctgacatccttggcctcccgtccatcacggaggatggagcactcttcatagaagagagaccagcccagcactgcccccctccaccagccgctcctctctcagcaccgtgtttggcatgaagcccccctcctgcatcaacaggagaaggctggtgccaacatgtggttccaatcagccacccactttctgggtcagtcaggaggctcgaatgctctaggctaaggggccggacagcccagttaaatataccttgtgacccctggtctcaaactcaccgtggccatcctacctctggctctccagcctgcatgtgtgaatggctttctccacgagactcattcaagtctcctttcctcccccagacatcctcccacccctccctgcctggaacaagtcatggctccctccttggggtgacaagggcacccacctccaggtccatccacccactcatgggtgagcaccttggagtcaggcctgggtcttgtcatctttatgccagccttggccctggcacagtatccaccatgggcagtcacttttggccaatggcttgtcttgctgagttagggggagacaatatccagtattcttgcctgaagaatcccatggacagaggagcctagcaggctacagtccatggggtcgcaaaagttggacacgacttagcaatgaaaccaccaccgcaaatatccagggaccacaggacgggagcagaaacagtgatgctatgaactgagcttcagttcaccccatggctccctgcatcctgaggaaggaggccctggttctccagactcatgaggccgggcgtggttgccctactgcctgctgcagctcacctcgttcaggacttcccccaactgccaccctcgatgctccggtctccatagacttcagtggttggaaagatctgtggatattgggggggcctttgtacactatttcctttcctgagacctgctgtcccactacccagatccattctctgcttcatccaactcccctttcagctctctacttaaaataacaaggaagttagggaccacttcctttctgaacgttctagattatgaactgaactttctagatattgtctcctcctaacaggtttgcaccacatcccgagtggttgctctagcatcttctgtgcactcactcccctgttgtgggacagagctaggtcttcccccgagcatcccctacctagcgctggccacgtggtccttggtttttcctgtaattatttgcttactctctactttcccacttcactcccagagggcaggaaatcctcctccccttcacagtcaaccagatgtcccacctagttgtctggcttactaggagtaaatgaacatatgaacggatgaatggataaactcatgaatcactgaaggagacctgaagaaacttaggacagagagccctgagcaaccaggattgaggtcaccttcaggcgagaccaaactggaactcaccccgtggtccaccacaaaactcactcttcgcttccggggaacaaagagcgactgttctctccccgagttaatgggatcttacaaggcagtggggtcagaggagaaaaggcaacagaaaactcccagagttttaacctgaatgtctttctctcttttcctttggggaaaaaaaaataataaacacaagtgttcttcactgagttctgaagaagaagcgggtggccgtggtgtggagcaggaggaagagaagctcttgaccgtcaacatctctgatctcagaggccgactcaaggagaaggaggccccactgaagtcacacttggatgccagactcccggtgcaggggagggcgccatggctgccaggaccagcccaggcacacacacacacgggcattcacggcccctcccgcccgccctgtgtgcccccagcagcaaacagaactctctgtctcggttcctgagtcaagcctgcacagaattaactgtaataattggcaggtgggccactggcttctgggtttcaattcagcaggggctcatggaaaaaaaaaaaaaacaaaactggatgttctgccgtagccagtatttagcttgggctctgagaagtttcagctttccatgacaagaaacaaactgtgtgactgcagctgccctgggcaaacaagagctccagaacagccttggagaaagaggcccttgctggcaaccatcagttcactcctcgggggaaagaggaggaaatggcccttgacctgctgcccttctcaggagctcagataatggagaagaaaggcgtctttctggaagcttttttcctcaaatggaagggagagatcatcacctccaaagatttttccacagcatgaatgtcctgtgtgtgtatgctgtgtgctcagtcgtgttcgactctttgtggccccatggaccatagccccccaggctcctcagcccatgggatttcccaggcaagaatactggagtggatgccctggtcactctttataagaatatctgtaataataggggttgccatcccagcccacaactgagccaccatttatcacatattcatttatttggctacaccaagtcctagctgtggcatgagaacttagtttgcagcatgtgggatctagttccctgaccagcaattgaacccaggcctcttgcattgggagttcagagtcttagccactggaccaccagggaagacccctgagccaccctttgacagtgtctaatgcccacgggacaggaaccagcctccactactgtgcttctgctattcatctactgcagacctccctaatcaacagtggttatcttttccactgagcctcagacatgggctcaggatcgttctcgacgttgtaccccaggaagccactagaaatgaacaggaattggcaggagagctgacaaatatttgccacttctattttggtaactcagaagaggccagagttacaatctcaccaaagtttctgcgtcgacaggaatccagtgatgtcctacttcaggactgtggcctttcatgccaattaccaaccaaacagagaatgcttatcactgctctccagagagtgggctctggtgatgatcttcctcggagaagatgacacagggcagaatttcaccagggacccgggtgcagtggcccagggctgggtcagccgatgccaagggcatgtctcttctgttcactgagcttgtacctgaagcttgtccttcaactggggattaaaaaaaatattatttctttttttttttttttttttggtttatttttttcctctctttttttaaattttatattttaactttacaatactgtattggttttgccatatatcaacatgaatccgccactggtatacctgcgttccccatcttgaaccctcctccctcctccctccccatatcatccctctgggtcgtcccagtgcaccagccccaagcatccagtatcgtgcatcgaacctggactggcaacttgtttcatatatgatattatacatgtttcaatgtcattctcccaaatcatcccaccctctccatctcccacagagtccaaaagactgttctatacatcagtgtctcttttgctgtctcgtatacagggttattgttaccatctttctaaattccatatatatgtgttagtatacagtattggtgtttttctttctggcttacttcactctgtataataaaaaaatattatttcaatttagcttttaagtttttagttacttatttatttttgcctgtgcagggtgctccttgctgcacgcgggctttctctaactgctacgagtcgggagttgctctttagctgtggggcacaggcttcccactgtggcggctcctttcttgcggagcaccagctgtagggtgcaggtagctgtggcccacagacttagttgccccgcagcacgtgaatcttccccgaccagggctcaaacccgcgccccttgcgtcggcaggtggattctccagcactgaaccaccagagacttcctcagctgcagattttgcgtccagtctgctgcagcagggacagagcggctaccaccctgcaaggctctcacgctgccccgcccccagcgattctggcagtgagtttctccctcactctttctcagcagccccgcttgcccattttttcataagaaactagtatgcagcactggtgtggggtcactctggccatccgggctgggaaatgctttacaagttggcttcccttggggtcaggtccacagtcttcccagaggagaagggccttagttcaggatccaggtaacaccagctattccttcctggatgacggtccttggttttccttccaatggcctttgggatgcgcctcctagatccctttccctctctggggttcactacatgagagagcaaattgcaatgatgcaattgcagttgcaatgatgccttccccttctcagccccagtctgaggaggaccctcttctgccctcacaggttggatgctatgtcctgaaagcttacctactactctaaggacaggggttgggggagatcctggcagctccttgctctcccatctcgctgcatggtgagagggctaactgcttggggtcttgggtgactacttcagctctctaaatctgctttctcacctgcaaaatgggaataatgacaccacctcctaggattgctctgaggacaaaatgagataatctctgtaaaatgcccagcaggcagtaagcacccaatggatacaggctgttatcagcagggagtagatatttcagccatagcatcactcctacgaattctttttttttcctatttatttttaatttttttaaattttattgattaagataatgatacatttattgaaagttttacattttcatattctggtcctggatgacttatgtgtaacatctttttttttttttttttttttagaaatttgtatgcaggtcaggaagcaacagttagagctggacatggaacaacagactggttccaaacaggaaaaggagttcgtcaagtctgtatattgtcaccctgtttatttaacttatatgcagagtacatcatgaggaacgctggactggaagaaacagaagctggaatcaagattgccgggagaaatatcaataacctcagatatgcagatgacaccacccttatggcagaaagtgaagaagaactaaaaagtctcttgatgaaagtgaaagtggagagtgaaaaagttggcttaaagctcaacattcagaaaacgaagatcagggcatcaggtcccaccacttcatgggaaatagatggggaaacagtggaaacagtgtcagactttatttttctgggctccaaaatcactaccatcactgcagatggtgactgcagccatgaaatgaaaagacacttactccttggaaggaaagttatgaccaacctagatagcatattcaaaagcagagacattactttgccaacaaaggttcatctagtcaaggctatggtttttcctgtggtcatgtatggatgtgagagttggactgtgaagaaggctgagcgtcgaagaattgatgcttttgaactgtggcgttggagaggactcttgagagtcccttggactgcaaggagatccaaccagcgcattctgaaggagatcagccctgggatttctttggaaggaacgatgctaaagctgaaactccagtactttggccacctcatgcgaagagttgactcattggaaaagactctgatgctgggagggattgggggcaggaggagaaggggacgacagaggatgagatggctggatggcatcactgactcgatggacgtgagtctgagtgaactccgggagttggtgatggacagggaggcctggcgtgctgtgattcatggggtcgcaaagagtcggacacgactgagcgactgatctgatctctgattgtactggttttgccatacatcaacatgcatctgccacgggtgtacacgtgttccccatcctgaacccccctcccttctccctccccataccatccctctgggtcatcccagtgcaccagccccaagcttcctgtatcctgcattgaacctggactgacgattcgtttcttatatgatattatacatgttttaatgccattctcccaaatcatcccacccttgccctctcccacagagtccaaaagattgttctatacatctgtgtcttttttgctatctcgcatacagggttattgttaccatctttctaaattccatatatatgcattagtatactgtattggtgtttttctttctggcttacttcactctgtataataggctccagtttcatccacctcattagaactgattcaaatgtattctttttaatggctgagtaatactccattgtgtatatgtaccacagctttcttatccattcatctgctgatggacatctaggttgcttccatgtcctggctattataaacagtgctgcgatgaacattggggtacacgtgtctctttcaattctggtttccttggtgtttatgcccagcagtgggattgctgggtcataaggcagttctatttccagttttttaaggaatctccacactattctccgtagtggctgtactaatttgcattcccaccaacagtgtaagagggttcccttttctccacaccctctccagcacttattgcttatagacttctgggtcgcagccattctgactggtgtgaaatggtacctcactgtggttttgatttgcatttctctgataatgagtgaggttgagcatcttttcatgtgtttgttagccatctgtatgtcttctttggagaaatgtctgtttagttctttggcccatttttggattgggttgttaatttttctggaattgagctgcaggagttgcttgtatatttttgagattaattctttgtcagttgcttcatttgctattatttcctcccattctgaaggctgtcttttcaccttgcttacagtttcttttgttgtacaggagcttttaattttaattagatcccatttatttatttttgcttttatttccaatattctgggaggtgagtcatagaggatcctgctgtgatgtatgtcagagagtgttttgcctatgttctcctctaagatttttatagtttctggtcttatgtttagatctttaatccatttaatcctacgaattcttttaaattatggtaaaatatacataacataagggcttccctggtggtttaggtgtaaagcatctgcctaccaatgcaggagacattgattcgatccctgggttaggacagtcccctggagaaggaaacggcaacccaccctagtattcttgcctgggaaatcccatgaacagaggagcctggcaggctacagtccatggggtcacaaaagagttggatatgacttagcaactgaaacaacaaacaacccataacgtattttgaagtgtgtgattcagtggcattaagtatcttcacagtgttgtgagaccattaccatgttgtaatcccagaatttttcatcatcctaaatgggaaccctgaacccatgaagttgtccctttctattcctcctctctagaaaccaccaatctgcattctgtgtctatagatttgcctactctggttatttaaatacatgaaatcacacagtatacagtcttttgtgtatggcttctacacttagcatgatgtttccaaggttccttcctgctgtaatatatattggtatttcattctccttatggctaaataatgttggggaaggaaatggcaacccactccagtattcttgcctagagaatcccgtggatggaggagcctggcggcctgccgtctatggggtcgcacagagtcggacacgactgaagcgacttagcagcagcagcagcaatgttctattgtattgctgttgttgttcagccactacgtcgtgttcaactccattgtacgggtacgctatttttgttattctcttcatttgttgattggcattcgggttctttcgacttctgggatgttgtgctatgaacatttgtgaacaagtttacatttgaacacctgttttcaatttgggggttatatatatacatatacataacatatgtaggagttgaattattgggtggcatgtaattctatatttaacttattggggaattacctattttccagagtgcaccatttcatatttcaatcaacagtgtatgagtgttctcatttttccacatcctcaccagcacgttctatttcacccttttaaaaaagccttggccagcctagtgggtttgaagtgatatctcgttgtggttttgatttgcatttccctgatgactaatgacatcgagcaacttttcatgtgctccttggtcatttatacctctttttttttttttgagtcctttgttcatttcaagttctttgctcattttttaattgggttgtttgtcttttttgtggtttctcctatgaattttgggtcattttctaaccaatggggtcaggaaaaaaatccaaagacatgaaaatgtgtgtgtgtgtgtgtgtttatgcgtattcaaattccttgtacagtttgaatatgcagggaataaaacaagctcctttattttgtctgtaatttgtcttccttttcagtctttactgttggctaatgggaatagattaatttttaatccactctgctctataatttagacccccaaatttaaacagtcctgtcagttatgttcagtctttctagaaaaaaacaaaacatactcaaattctcagatttctcttctctggtcccaagatagtcatggcctctgagagtatggggtggtgatggttcagtaacctccaggcagaggggacatctcagcatctttagggtggtgacttttgcttctgcttggctccagggcaatggcccttgtctgcaagttgaacctcatcatgccggaaatggtggccaaaagccaaggccatgtggtccttcttcaactcttggctccatgcaaagccacctgcttcctatgacttggcctccccgttgaggtctggctgtgacttcccatgttctactctagccagacccctggctcctccttaatctcacctcaccacaggtaaaccaaagacagctcaggaaagctaaagcctcagggacttcctaccaaaccaccccaccccagtgtgtttgtacagagaactgcccccagggcagctgcagcatccttccaggtccccagagaaggagcacgtggagcaggtggagggacaggatcctggtcccttggaagagggagaattcaggttatggcaactgagccgatccttgaggatcgggggtagcatttccaagtgggaactctgcgttctgatcatactttgttcctcacagcacctgacatcatgttggacaaggcaaagatggatgttcaagccattgattgttttagctgatggtgagagatgaacaccctgggaggttgaagaacacagctgagtggctatttctctttgaatcagaggaacagtcaaatggctaccccaaacacatctctgccatggaccatgaattcccccaacttactgctcacaaaatgacaagtgcagtgtctgtatttataacccctcctgccagtcttgtgggtcagaagaaggtatattctcctcctctttggagccaattctcccacctgtgctcttaaattcccaccccttcatcttctttaagatctagaccctgattccaggagctcaaagagaggttgatcagctcagagcaatagagaagtggttgatcagttgacttatggctagctcctacaagcagaaactgctgaaccttcccttgcctatgggctttgccactgcaaatgctttcatcctgatccatctgccagtggactacaaaatcaggaacatttaagggtctctgtgatgagggctggaaagaccaagccactaaccccgttggaggaggactgatgaaagagcttgaacaaagcaatgaggatgctcagaggatacaactagggtctgagaaatggacttcttggaactactaaaagaaaattattctttgttttataaacttcagaaataaacagaaaataggataatcactgctgagctgtgaattataggcctagaagaccaagggaaagaaatagctcatgatatggaaatacaaagggatggaaaccagtcgggaccagtaagagacttagaggaccaaacaagagatgactttcaaacagtattaccagtttcagaagtggggtgggaggagaggacagatgatgaaggagaaacaatagttaaataacaagaaattttccatgttgtgacacaagatttaagcctgtagattgaaaagcccaagttccagatgggattattttttaaaaaagacaaacacctagacataacttggtgaaaccttggaattctaaggatgagaaaatttgtttatgaagatgagaggaatgaagggagagactactttttctttctatatctttgcattgttttgcaaataaaaatgagtactcattattttaaaattgacaaagaaaaatattttaatgccctttcatgatgctcatttgtcagtggacactcttaggccagcatctaacagcatgcatggttctggacccaattcccaactgtctaaatatcattggtttcctcttacacttgggccctgaccagcctggactccttcagctcagcaggcactccttgtgccttgatttggagcctggaactgtatttgacatttaactgacatgatgagtaggtatggttcctgttctcaaggatcgtaagtcaggcaagagctgaatttgttccactgggttgagtctctgggcctttgttctttgctgattttcaggggaaaatcttcttgcagaagatcatgtacatttcttccatctgcctacctactgctaactgctaaatcgctttagtcgtgtccaactctgtgcaaccccatagacggcagtccaccaggctccactgtccttgggattctccaagcaagaacactggagtgggttgccatttccttctccaatgcaaggaagtgaaaagtgaaaaaaaggtgacctgacactacagtaaattccctacatacaaactcttcaagttgcgaaatttcaaagatgtgaatgtgtgttcatatgtccaatcacgtaacttattggcatacgttgtcatgtgcacacgtgtcctacaagtggttgtgcttttgtgtactttagagcactgcgtggcgtatagtagtacagagtttttatttttaagccagatctgcaagaggacaacttcactgaactccttgctatgcaacacgagctgcttactaatgaagacctgatggagttggagatccagagaaaggatggagagagagaaaggaagaagtaactgaataaccaaagagattcatgacacgggagacagcaagggtgctttctttatttgagggggcaccgttagattttgggacccaggacccaaatgtagaatggacccaggacccaaatgtagaatggttcatgaatggttcagcagccgttcaaaatgcaatccagtgctgccatgccatctatgatgagctgctacccagacatcactggattgtgttcttttttcacttgtgtcccctccctcctgaacacttctcgcacctccctccccctcccatccctgcaggttgtcacagagcaccagctttgggttccctgcatcatacatcagactcccactggctatctactttacatgtgggaatgcatgtgtttcagtgctattcttgcaagtcaacccactcaagaggatagatagattgaattgagcaaggaacccgaacctgtgccatcaacatcaggcatgagtgaaattacagcttgccttccatctcctattggtgatgatccttcagctctaccatctcccacctcctctctctctagtcagtaactcttcttgcctgttcactccatgccagcccctgtgtgccagctgttgtatggtactactgtacttttcaaggtactgtactgtaagattaatcatgttttctttactaccatctttctagattctatataaatgcgttaatatacagtatgtgtctttgtctttcaaggcagcagtggagatgcagacacagagaacagacttttggacaaaaggagagagaaggtgggatgatttgagagtcacatggaaacatatatgttaccatatgtcatgtagatgtgtgcgctgtgtgctcaggcactcagacggaggacactgatcagttgcggtgtcggactctttgtgaactcatggactgtataactctcacctctgagaggatctgaattccacctttggaatgtatgtgtgcatgtgtgcacgctaagctgtttagtcaagtccgactctgcgaccctttggactgtagctcatcagtctcctccgtccatgggattctccaggcaggaatactggagtgggtgccattgccttctctgggggacttgctaggctacattataatttccctctgtttggaaaccgtccacctaatctttaagattgggtcctcattcactttgctgatactatgggacctggacactctgatcacaattgggagccacaaggctagacacctgaccagcccaatcagatcctctcatcttagaatttgaaatttaatcagaggctcaatcttggagattggctgtgagtcatctccatagcaatttcatagaccagactcacaaccccttatggggaaaggccctagctggggaactgtagctctggtcttcccatggccagttacttttggcttctttggcttggggaatctttactggcaaatgattttatgtatacgttattcaaattggtggctattttttcaatcaaactcattttaatcaagaaagaaatttgttgcttatctgaccttgggcaaaacactcttaacagtcacaagtttcccatttataaaataagcataagtttttctgccctgtttaatccttgggactattaaatggaatcaagtatatgaagttctacaaaagccgtgaaaaaccatacaaatataagtggggctacttgtctatagcaagaggagttttaaaagctttctccaagtatgaaatagaaggctttctttctttcttaactttaattgctttgtggtcaattcctcttaagcacaggaaatctccatagttagaggtttacttttttcttttgctagatatttaatactttgattgtttttgacactaaaattacccattatggtgttgcctttgccaaagcaaacccaaattttatattattatttctgtttggggccatattcagcatctctgttcaagagtctgaagcaagcaattattaccaattccatcatacccactgcactctttttataacatatctcacaccccttgtactttcctggaatgcaattgcatgcatttcctggggaaaccataacaaagtaccatagactgagtgacttcagaactagaagttcattgactcgcagttctggagactagaagctgaaggtcgggtgttgacaggattggtgtcttccgaaggctgtgaaggaagatctgctctttgcctcacttcttggcctggagatggctctgttatccctgtgtctctgtgttgtcttccttctctgtgtgtctctgtatccagatttcccccttacagtaaggacaccaccatactgaattggagtccaccctaatagatcaaaccagtcaatcttaaaggaaatcaatcctgaatattcattggaaggactgatgctgaagctgaagctccaatatgttggccacctgatgccaagagctgactcactggaaaagacaatgatactgggaaagtttaaaggcaaaggaagaaggggactgcagaggataaggtggttggatggcatcaccaacacaatggacatgaatttgagcaaactcttggagatagtgaaggatagcctggtgggttaaagtccatggggttgcaaagagttggacacaacttagtgactgaacaacaacaacagctagggacctaattttaacttggttatttctgtcaaggccttatttccaaataagatcatattctgaggtgtagaggttaggactctcacatttacatgtgtatggagggatgcaggcacaattctacccataacagaaattaatcacctactctcaccccgcctcccatcagctcatccctcaggtgcccaagcgcagagctgtgttcatgttgtggatgtttccatctgcagccaaccttctcacaaggagctctgcattcctgctagaagatgggattggaggcatgcttaaatgcactactgacaccaacaagaagaatcaaaccaaataaaaaagcttctgagtaggggttcagagcatcagtaaaccatctttgttctggagctgggaagaagactttgatgcagggaacaaatggagaaaatgtggtccctgctcaccctctgtgaatctgaagacagagtaaacacttccaggcattctttctagccagggaaacaggctaagcagttgtctggagccaaagactgccaggagtaataagaaaacccttaagtgagttttctccatctgtttagtttcttatgctgaaaaaaaggaggaaaaatataaataaatgattcagagaaatgtcacatgccattacctttaccatgaaaaaataaacaaggcttcacttcattaggcaggttctaatgtgaccagtacgttctggtggtggcctccctgggctggagatcttcaagcttatgaacttccaagttggcttgcctaaattcaacttcagctggaacttggctccagcctccaggaagggccatctgtgggggtatcaatccctctgggcatctccctatcaatcctgttacccaaaaatgaaatcaggttaaaggcagcatctgggtagcctggaaaatgagaagttgagatgtatgatatgtagatgtaggaaggtgtgcaggtgtaggaaggtggggctggctctatggctgtccataccagctgtccatctttttaacaccagatacactagccagcttccagtcccccaaagcttcctttggatggttcagagcaaattacagcatggacccagctgacaaatcttgatacatcatgcctttaacattgattctgcccaacactggagcaaaataagtccatttggacctttaactttaaaatccagttcctcaagatggcaagagtgtgttcccattgcgctcagtcatgtctgactctgtgtccccatagcatgccaggttcctttgtccatgggatttttcaagcaagaatactggactggtttgccatttccttctccaggggatcttcctaccccaggaatcgaaatggagtctcctgcatctcctttattggctgctgctgctgctgctgctaagtcgcttcagtcgtgtccgactctgtgcaaccccgtagatggcagcccaccaggctcccccatccctgggattctccaggcaagaacactggagtgggttgccatttccttctccaatgcatgaaagtgaaaagtgaaagtgaagtcgctctgtcatgcccgactcttcgcgactgcatggactgcagccttccaggctcctctgtccatgggattttccaggcaagattactagagtgcggtgccattgccaaacagattctttacccctgagccacctgggaagccctggttcttgttagtctccagctaaccttctaaacttcgagcagtgccagggaagattgtcactgaacaatccctataaaacagtgtcctttacaaattctctctgcagagcactgagtccagggtcttatgtgccaagctcttcagcaaccaggatttggagatggtgagtgttgagtggcaattgctttctatgctgacacctctgtccccctccagcccacacaccaccagcttttcagaaaaaagccaaggccacattctaccagcaacctcaacttttctcttccttatatcatagcttttctagaatttttctccccctttccttctcattctcttttactgtagattggtgcaaaagtagttgtggttttgcattgttgaaacttgctgtttgatattggaatatattcttaaataaatgtggttatgtaatatatcactttaatgcacatttctcactttattattttttgttaatggtctgttacttactgttcttttgtatttatttaaactaccgaaatgatgttagataaaaagcaaatttgagagatttttttaatttgagttcaaaatgggtaaagcagcggagataactcacaacagcaacaacgcatttggcccaggaactgctaacaaatatgcagtgctaacaagtgctaacaaatgcagcagtggttcaagaagtgttgtaaaagagaccagagccttgaagatgaggagcacagtggccggctgtcggaagttgataatgaccaattgagaggatcactgaagctgatcctcttacaactaactacatgagaagttgccaaagaactcaatgtcaacaattctgtggtcgttcagcatttgaagcaaattggagaggtgaaaaagctagataagggggtgccttatgtgctgaccacaagtcaaaaaaattattgcttcgaagtcatcttctcttattccatgcaacaacaacaaaccatttctcaaatggattgtgatatgcactgaaaagtggattttatacaactggcaatgaccagctgagtagctggaccaagaagaagctccaaagccaaagttgcaccaaaaaaggtcaaggtcactgtttggcggtctgctgccatctgatccactgcagctttctgaatactggtgaaaccgctacatctgagaaatactctcagcaaactgatgagattcgctgaaaacagcaaggcctgcagctggcattggacaacggaaggggccccgattcttctccatgacaacgcccagctgcacatcgcaccaccaagacttcagaggctgaatgaattgggctatgaagttttgcctcatctgcaccatatttacctgacttctcaccaacttattgctacttcttcacatgtttattatttgccaggcattttgctgcatgctttatatgcattatctcatccttcacataaatctatgaagccccctctattattagtccattttcaaaatggggaaactgcggcttagctgatcaagtaaatcaaggtcagcataattgacaagggcttcccaagtggcactaatagtaaagaacttgcctgccaatgcaggagacataagagacatgaattagatttctgggtcaggaagatcccctggaggagggcatggcaagccactccagtattcttgcctggagaatccccaaggacagcagagcctggtgggctacagtccatggggttgcacagggttggacatgactatcgacttagcacacacatagttgacagatggaggagccaggatttacactcaagtccgctgaccccacagtctgagctttgaagtggtgactcttggctcactactgtggttacttcttaactggtctcaaaaacatacagattttcctgtgctttctctaggccttcttcactatcccagagtcatctccctaatgcgtaaatgggactgtaccttctccaaccttcattacctgcagcatcaagtccaaacaccttagctcgacattcaaagtcccagtgctatcaggaagattacagctctcgtccttgaggagaccccttcttatctccatttatagaaatcttctttctccttcaatgcctggtgcaaatgtgatctgctccatgggacatttctgaccacactaactagaaatgttgtcctctttgcttaaactccactgtgcttaatttgggctactcctgttatgtctgtgccctgggctgattcataatatgattatctgtgttcatgtttagctatagtcttgaagtcaagagcgtccatttacttatttatttttaagttatttctttatttttggctgtgctgggtctttgttgctgcacgcacgggcttcctctagttgcggtgagcaggggctgttcttttgttgcagtgtgtgggtttctcactgaggtgccttctcttgttgaagagcacgagctctagagagggagctcaacaattgcggtgcacaggcttcattgccccacaacgtgtatgcagatgacaccaccctcattgcagaaagagaagaactaaagagccttttgatgaaagtgagaggagactgaaaaagttggcttaaaaatcaacattcagaaaactaagatcatggcatctggtctcatcacttcatggcaaatagttgtggaaacaatgagagactttagtttttggggctccaaaatcattgcagatggtgactgtagccatgaaattaaaagatgtttgctccttggaagaaaagctatgaccaacctagacagcatattaaaaagcagagacattactttgccaataaacatccatctagtcaagctattgtttttccagtagtcatgtatggatgtgagagttggaccacgaaaaaagctgagcgctgaggaattgatgcttttgaactgtggtgttggagaagactcttgagagtcccttggactgcaaggagaatcaaccagtccattctaaaggagatcagtcctgaatattcattggaaggactgatgctgaagctgaaactccaacactttggccacctgatgcaaagaactgactcattggaaaagaccctgatgctgggaaagattgagggcaggaggagaaggggacaacagaggatgagatggttagatggcatcactgactcaatggacatgagtttgagtaaagcccgggagttggtggtggacagggaggcctgatgttctgcagtccttggggtctcaaagagtcggacatgactgagtgactgaactgaactgaatgtgggatcttagttcccaaaccagggattgaacccatgtgccctgcattggcaggtggattcttaaccactggaccaccagggaaatcctccctttatttttgcagcccttacaacatctgtcagaatgtctcacacaaaggaagtgtattaattgagtgaacactgactgctgtaacagacatccccgaatattagtcacttgacacaatgaaagtttgtttctcactaatgtgaagttcgattggtgacagagtaaaccctgcattcgttcatttgagttcagagtgatatgaaaaatgaaaattagataataattacttagttaagtgggtttgtggtttctatcatcttgcttcaacaaaaccaacacccaataaagtggataagtgggctttaaatgaacctgtagagaaattacttacatataatgctaataaaaacagtggtgaaccaccagaaaaatgtcagggctgacgcttctccagatgccaagggcttacttggttacattatgaggcaaaacaatgataatctatttacttctggcaacaagtcacatacacacacacaaaacttgaccagatcaaaaaatctgcttgaaatacggacttctattatctgccattagcaatggaatccaagtaaatgcatattgccatttgggttatcactaaagctggtatgaggccagcactatttacaaacatttaaaaacgtattggggttgcaaaatgtcagacacgatgtagcaactaaataacagctacaacatattatccagactatgaaggtaaatttctagcgtttaaacattcagggctatccaccattccatccagtgctttacaaaaatcacaataaatttgtcaataagtatttggaagccccttaagagcttaaattttatatttaatagtaagtttcttatttaatagtaaatgggggaaaagatacacgctatgaaggaaacacttattcctattgtggtggcaacagctcaaaaataatgcagggaacacaaatgggtgaccaaacaaaaaatgcattcctttgtcagcaaatactgctggaagaagcctgggaaatatcactgaagctgtgaagaaacaagttctaggagaaatgagactgcgtgggtggtttactacagagttggattgaagtacagatgtttctgacatgtctcagcctatggaattcgttcattctactcggtcatggaatatatccaggactactttctttgtaaacctctaaaagaaagatggactggagaagatatttttagtgctaagtgacacaggaataatgttgtatgagaacatggtacactgtaacccttgacgtggcagtccatttgaccaaaataaaaaaggaagcccagggtagccttaagggatgtatccaagggtgaatttttaaaaaatattttattaaaaattttttatttattttggttgtgttgggtgttcactgctgagggcgggctttctctagttttagcaagagggggctacccctgcaggacaagggcttttcattgcagtggcttctcctgttgtggagtataggctctgggggcttgggctttagtatttacagcctgtgggcttagtagttgtggctcgtgggcttaattgccccgtggcatgtgggatctccctggaccaaggatggagcccacgtcccctgcactggcaggtggattcttaactactggaccatcacccaagggtgatttttatttattactcccttcacaggaacttatcattaggaagaagtcatagctggagggcacaaagttttagaagacgatattgatgaggctaacttccaaaacaaaatatagcaataaaacaaacacacaaaacgttaagttattaaagagttccttgagtattttgtaatagaagtggaagtattgtgaacgtgttttggatcatacagagatttacaggttatcttttgtaaaacgctttaatggattttccaacttagagtcagggcattccttgcttttaccataagattagtgttgcaaattcacagtttctgaggcatgtgttggcctgtggtttgctagctggcagatttttttttggagtgaaaaataaacataatctgtaaaggtaaagttgattatcttaattttgagcaagtacattacttaactgattctcaagaggaaaccatgctatgaagaaagcattttgaaaacagatatttggaaatctttcatggctatatagtacttttgttgaaaaggatgttttagctataaaaattcatatctgcatgttaaaaaatgaaaaaaaaaatttaacctgttcaaaaatacttcagaggaagtatttcagtgagtttttagcctgttcattaaaaatgttaaaaagtcgatgccttctgattagactgcaagaaacttctgttaaatgaggagaaaagaaacttagtgcaatttcaagaaagacttggtcgtggtttgtatgaaggattgaataatgagcatccagacccagtaagtacaaacagacgctcagatcttctgcttagctctctcatattggacagtcactttttaaaatccatcatagccagtaaaatcacatctctaaacttttgttgttttccaaagtatgaagctgacttgcaaaaataatgaagtatattaatcacctctctttcattaaagatgtatttgaagtacctttcatcatcagtccctattctgtaggacacgagtgacaatgcttaattcagtttatagaatgtcagttatatataaaatagataactaacgagagcctactgtgtagctcagggaactttactcaatgctctgtggtgacctagatggaaagaaacaaacagagaaatctcaaacagaggggatatatatgtatgtatgactattcactttgctatacagaagaaactcggagaaggcaatggcaccccactccagtcctcttgcccggaaaatcccatggacagaggagcctggaaggctgcagtccatggggtcgctagagtcggacacgactgagtgacttcactttcacttttcactttcatgcattggagaaggaaatggcaactcactccagtgttcttgccgggagaatcccagggatgggggagcctggtgggctgccgtctatggggtcgcacagagtcggacacgactgaagcgacttagcagcagcagcagacagaagaaactaacacaacgttgcaaagtaactctactccaattaaaattttaaagaaagcaaactctgtcaagcatgtgaccgcctgtgaccctagcattagtcacaagttgctgacaggatcataagcaaaaacaaagtttctgagtggtttgaggaatttgaatggctcaatttgatggctttcaaacgaggtacaagaagttgtcctttaaaaaaaaaaaaaaaaaggccatctactggcttatctgtgccgaattaaaatgtgaataaggcctgcactagaagagaagctggttaagaagaaatacctagtaatgtctccttcactcattcaacattttattggttctgtaccatgtggcggacaccctgtaggcacacatagccaagacaaggccctgccctcaaagaactggagcacagatgcccttgatgaccaaacataaaggtcaagtccaaacactggctaaaagtcttgcctccccttcttttcccactttcctcagttgaggttctttcacaaaatgacttaacaccatctccctccaaattcttgccattgtgttcttggtttccctgctgggaattagcgaaaggtctgtcattctacaatcttgaaactttgtgctagttaattaaaaatctcctaacagttcagttaatcccatctgctttcaacctgagtcttctcacaatgtagagatttgtgtttctggctcttttgtcattctcctcacagcttcttattaaatctcttcttgaagccattaacagcttcctcttatcttcctctggtaggaaaatagagggacatgttgttaaattgacatgaagggacgtgataataaacaaccattatttatgagcaccaattcccttcttggtagagggctgaatactctacaagcattatttgatttaatcttttcattccaacagttgaacctcactggggaaattcaggctctgaggctatttaactgccccagagtaacacagagagtcagagcccatttttttttaagtctttgttaaatttgttacaatattgcttctgttttctgatttttgaccaccaggcatgtggcatcttagctccccaaccaggggtcaaacttgcaccccctgcgttgaaaggcaaattcttaaccactggaccaccaaggaagtcctacaacccatgtttgtgcaatgacaaagtccacagtctaaccgttaggttccctgtctttcctctttaactgtgtaccaactctgaaacaatcccacacttaacactttaaactagttaacatcaaccaacaagtatcctgcatttagtgacaagatgctctcagacccttccaccatccaaccagtgggtcatggttttgcaattcagatgtgcgggaaaacagtcttcagttttacaaacactgtccttgacattcttgttagtatccaagggactaaggccccctccatctttcttttccacttgccctcatgcccttggctatggccacatcaaactaccaagcctttgcatgataacttgttacagcctctagagttacttctgttactctagaagtaactagagttacttctccctttaactccttccctattcatcccctgcctgcttgttgatctctattgatcctcaaggcctaggtcaagggtcctatattccctgaggctgtgcttgagaccaactccgaccagctgtcagcagcatgatcatccctctctgggaccacacatctttgttcacacacactgaccacactcttactgtccattgccctgctggacagaaactgaggctgtgtctgttcagggttttatctcagcacctaccacagcatcaggccctgggggtggataattagtgctatttgaataaatgaatgaatgaataaaaagaaactgtggaacgggaacagaaatgggaggatctggggagtctgtccatctcgtgggctggaatggttttgcattccagaactttgcacaaacactcagatgcaattcagccagccagtgtgggtggtgtgacttggagcaggggatgaagaggagagagagctctcctaagtatccactagggttgggaccccccacaacttggcctgatccaccaagttcaacccaaagccaggaattcaaaaaaaaacatcctagtcccctgtatgtggccacagcacaaaataacaagactgttgtttttaggatctgggacactgtgaaaaaataaagggtaaaagtgaactgactacacacctaaaggttacatcttcctggggtggagcattagtgtagacagggaggcaaggggagtgtgctagcttcctgttgctgctgtaacaagttatcacaaactccgaggcttaaaacaacacaaatgtattgcctcacagttctggagctgagaaatctgaaatcagtttctgcaggctaaaatcaaagtgcaggcaggtctgtcttccttctggaggctccaggggagaatctgtatcattgccttttctggtgtctatagatcatctacttagcctggctcatggtcccttcctccatcttcaaagtgttttacttctactctgcttctatccttaggtcatcccacctctcattctgatccttgtcattctgacaatctcttatcaggacactcatggtattattaagctccccaggttgtccaggaagatctccccatctcaagatccttactgtaaccacatctgcaaagtccatttgaccacgtaggcaacatttttataggttgccagtattaggacgaggccattattctgccaaccatagggcttattgtttagtcactaaattgtgtctgactctttgcaaccccatggtctgcaaaacatgtcaggcttcccagtccttcacaatctcctgtagtttgctcaaattcacatccattgagtcagtgatgccatccaaccatctcctcagtcaccccttctcctcctgccctcaatctttcccagcactaggatcttttccagtgagtcagctcttcacatcaggtggccaaagtattgaagcttcagcttcagcatcagtccttccaaacattcagggttggtttcctttaggattgactagcttgatctccttgctgtccaaggaactctcgggagtcttctccagcactgcaattcaaaagcatcaatgcttcagtactcaggcttctttgtggtccaactctcacatctgtacttgactactggaaaaaccataggtttgactatatggacctctgtcagcaaagtgatgtctctgctttttaatatgccgtctaggtttgttataccttttcttccaaggaacaagatcttttaatttcatggctgcagtcaccgtccataagaggtaaattcaggagtctgtgttctatgtccccgagaaatatttttttttgtaaaggtaaaaaggaataacagtcatatcaaccaaatacagcccttacactaaaagaaagcatgaggcttccctggtggtctggtggctaaggctccacactcccaattcaggggacctggctttgattcctggtcagggaactatatcccacatgctgcagctaagagttgacatgttacaactaaggatcccacatgctgcaacaaagatgtatataaaagaaaacaaatcaattaaaatttattttggcttacttttgaacaaagcagagaaaaattcacttaaggtataaataacctaattaactctggttgaactgcaaccctttcactgactagctctgtggccttgggtgacttatttactttccctgattgatcaaaacaagaatgcaaataattattcatgtattcacctccccatcgacactatgatctcttgatctcttgatgacaatgggaaatttttaataaatcatacaaagcataaaaaattaattccatgtcttcaactctaatatatcataattccactgattaaaaaatatagaaatgcatacccatttgactcaaaacccaaaagatgcacacagaaatataaaaggctgactgtacaactgggatagaactagaacaaatagattcagtgaccttgaacgtagacaaggaggagtctcatgaacattttctaatattttcaatagacatctgttattttaaaattattttccaactttattgagatataattggcatataaaattgtataagtttaaggtcttgtaggtcatcatagtaccattcaacttcagcttcttgggcattagtgattggggcatagacttggatttactgtggtattgaatggtttgccttggaaacgaccagagattctgtggtttttgagactgcatccaagtactgcattttggactcttttgttgactatgagggatactccatttcttctaagggattcttgctcaaagtagtagatataatggtcatctgaattaaattcacccattctggtccattttagttcattgattcctaaaatgttgatgttcactcttgccttcttgattcatggacctaacattccagattcctgtgcaatattactctttatagcatcagactttacttctatcaccagtcacacccacacctgggcattgttttccctttggctccatcccttcattctttctggaattattcctccattcttctccagtagcattcaggcacctaccaacctggggagtttatctttcagtgtcctatctttttgccttttcatactgttcatggggttctcaaagcaagaatgctgaagtggtttgcccttcccttctccagtggttcacgttttgtcagaactctccaccatgacccatctgtcttgggtggccctacacagcatggctcatagcttcattgagttagacaaggctgtggtccatgtgatcagtttggttagttttctgtgatggtggttttcattctgtctgccctctgatggagaaggagaagaggcttgtggaagcttcctgatgggagagactgataatgggggaatctgggtcttgttctgatgggtggggccatgctcagtaaatctttaattcaattttctgttgatgggcagggctgtgttcactccctgttgtttggcctgagaccaaactgtggtaggggtaatgaagataatggtgacttccttcaaaaagacttatgcccccactgttgtattcagtgcccctgaccccatggcaagcctctctcaacctatgcctctgctggagactactggacactcacaggcaagtttggggcagtctcttgtcgggacactgctcctttctcctgggtcctggtgtgcacaaggttttttcttgtgccctccaagagtctgtttccccagtcctgtggaagttctgtaatcaaatctcattggcctccaaagtcaaatcccatgtggattctcagtccctttgctggatccccaggttgggaaatctgttgtgggtgctagaactttcttaacagtgccagaatttctttggtataattattctaaagtttgtgggtcatcttctcagcggttctatggtggggctaatggtgacatcctctgaaagggcttatgccacatgccatgtgacccaggtctgctgcaaccagagcccctgtccccacggcaggccactgcttacctgtacctccgcaggagactctcaaatactcaaaggcaggtctggctcaggctctgtgaagtctctgcgtcttagtgtgcacaaggcttttttttgagccctttgagtatctctggcaggtatggggtttgattctaaatgattttgtttctcctaccatctacttggagtttctcctttgctcttggacatggggtatctttatttggtaggatccaacattcttctgttgatggttgttcaacagcaagttgcaattttggagttttcacaggagaagataagtgcacatccttccactccatcatcttgtgcttcgtcttaggggactggaatataaaagtagggaagtcaagatatacctagaataacagacaagtttggccttggagtacaaaatgaagcagggcaaaggctaacagttttgccagagaatgcactggtcatagcaaacagcctcttccaacaacacaggagacgactctacacatgaacatcatcagatggtcaataccaaaatcaaattgattatgttctttgcagccaaagatagagaagctctatacagtcagaaaaacaagacaaggaactgactgtgcctcagatcatgaactccttattgccaaattcagacttaaactgaagtaggaaaacccactagaccactcatgtatgacctaaatcaaatctcttacaattatacagcgtaagtgacaaatagattcaagggactagatctgatagacacagtgcctgaagaactatgcacagaggttcatgacattgtacaggaggcagtgatcaagaccatccccaagaaaaagaaatgcaaaaaggcaaaatggttgtctgaggaggccttacaaatagctgagaaaagaagagaagggaaaggcaaagaagaaaaggaaagatatacccatttgaatgcagagttccaaagaatagcaaagagagctaagaaagccttcttcagtgatcaatgcaaagaaacagaggaaaacaatagaatgggaaagactagatatttcttcaacaaaattagggctaccaagagttcatgcaaagatgggcacaataaaggacagaaatggtgtggacctatccaaagcagaagatattaagaaggggtggtaagagtacacagaagaactatacaaaaaagatcttaatgacccagataaccacgatggtgtggtcactcactagacccagaccagacatcctgggatatgaagtcaagtcggccttaggaatcagcactacgaacaaagctagtgggggtgatggaattccagttgagctatttcaaatcctaaaagatgatgctgtgaaagtgctgcactcagtatgcctgcaaatttggaaaacttggcagtggccacaggactggaaaagatcagttttcattccaatcccaaagaaaggcaatgccaaagaatgctcaaactactgcacaattgccctcatctcacacactagctaagtaatactcaaaattctccaagcgaggcttccacaatacatgaacagtgaatttccagatgttcaagctggatttagaaaaaccagaggaaccagagatcaaattgccaacatctgctggatcattgaaaaagcaagagagtttcagaaaaacatctatttctgctttactgactataccaaagccattgactctgtggatcacaacaaactgtggaaaattcttcaagagatgggaatactagaccaccttacctgactctcaagaaatctgtatgtaggtcaagtagcaagaattaaaactttacatggaacaacagactggttccaaattgggaaagcagtacaccaaggctgtatatcgtcatcttgtttatttaacttatatgcagagtacatcatgtgaaatgccaggctgaatgaagcataagctggaatcaagattgctgggagaaatatcaataacctcagatatgcagatgacaccacctgtatggcggaaaacaaagaggaactaaagagcctcttgatggaagtgaaaggggaaagtgaaaaagctgggttaaaactcaatattaagaaaacaaagatcatggcatccagtcccatcacttcattgcaaatagatggggaaacaatggaaacaatgacagaccttattttggggggatccaaaatcactgcagatggtgactgcagtcatgaaattaaaagatgcttcctccttggaagaaaagctatgatcaacctagacaggatattaaaaagcagagacattactttgccaacaaacatccatctagtgaaagctattgtttttccagtagtcatgtatgtatgagagttggaccataaagaaagttgagcactgaggaattgatgcttttgaactgtggtgttgggaaagactcttgagagtcccttggactgcaatgagatccaaccagtccatcctaaaggaaatcagtcctgaatattcattggaatgatggatgctaaagctgaagctccaacactttggccacctgatgtgaagagctgactcactggaaaagaccctgatgctgggaaagattgagggcaggaggataagggttcgacagagggtgagatggttggatggcatcaccgactcgatggacataagtttgagcaagctccaggagttggtgatggacagggaagcctgatgtgctacaatccaggggatcacaaagagctggacatgactgaactgaagtttaacttgtgcaatgttgatttgatatgtttatatattagaaaatggttaccaccatagctcgctatgctgagctttcctgatggggaaatttccctatggctcagaaagtaaagtctgcctgcaatgcaggagattcaggttcaattcctggttcagtaagatcccctggagaaagaaatggcgatcctctccagtatccttgcctggagaatcccatgggcagaggatcctggtgggctacagtccatgggggtcacaaagagtcagacacgactgagggagtaatacttaaatagctcactaacaactctataatgtcatataaccagcatgacttttttgtggtaacaacatctaagatctactctctcagcaattttcaaataaaaatacagtattattaactataatcacccagaactacattagattcccagaacttagtcatcttctacctggaagtttgtgttctttgaccaacatctccctcttccctcagccacccaggccctagtaaccactgacctactttctgttttttcaagttccacctttttaatttgaaaaaatatctggctgcattgagtattcatcgggcatgtaggatatttagttgcagcacatggaatctagttacttcaccagggatcaaatctggaccccctgcattgggatctcacagtcttcaccactggaccaccacggaagtcccaagttctgcacttttgccttccacatatggggtttccctggtggttcagacagtcaagaatctgcctgcagtgcaggaggcctggattcaatctctgggttgggaagatcccctggagaagggaatggcaacccactgcagtattcttgcctggagaatttgtggacagaggagcctggtgggctacattacatggagttgcagagtcaaatacaactgagtgactaacacatacacacattccacgtataagtgatgtcacacactatttcctctgactcacttcactctgtatgacttaggagccaagctgggtatccctgacctagagagaaaactcaggtgaccctaaggcccctggaatggcagacatggatttggtagctggaaaggttgtggtggatgtgctaccagattttggctaagattatgaagcatccagggaggaggaaacttatggatatttcccttctgggcttggtggtcttggaaaaaggagatttatcaagggagagctgttgcctgggaaaggccagctgctctgcagcctagaggtcttccaaagtgtatcttgttgcggagcccaggtccagggcaaatgcgtgcgatcctggctctgtcattccagttctgctctggagcagcaatatttcagatgatgcccactcctggggcttgagactcccaccttccgcaggtggggtgaggtcgtgagagaggtggggtccgtgtgtggggacctcacagctgtgggcagtgagaacccaggtgtccctgcctgggctctgagcatgtctccccactcctgtcttctcccgtcattctgtgcctctcccttggagaacaggactttgtacatagtgatggcatgcacgcgtgctcagttgtgtctgactctgcgacccctcagactgtagcccaccaggctcctctgtccacgggattgtcccagaaagaaatctagaatggattgccatttcctcctccagggtgtcttcccaacccagggatcaaacctgagtctcctgcgcctcctgcattggcaggtgggctcttaacaaggagccacctcggcacctgtacatagtgattagttattgttcaataagtaaagatgtctttaaaaattccaagtttaaagttatttagtggaaaagtaataaataaacccaatgattactattctttgatgagacaggatgaataaaaactcaaagactgtcgaactctaggcattcacgaaatggcatttccatagaaagagaagggagagtatgggtgatgaggctggaaatgggcatccattttccatccccacactcctctaacccagcctagattgagccttagaatcggtgggagaatgttgaaaaaaataacagtaccagaggccctctccagaccaattaagtcagaatctctgggcatggggccagagccttccaatttttttaaaaaagcttaattttgagccaccctaatgtccatccaagatgagaacagtgaacccggctactttgtattccagcctcccaggcaatgaagttctggaagtgaattctgagcccctgtggtcacccctccatggtgtctatggcttggtctgacccacccccagtctgcacctgtcttctttcctatcagatattcatcaaatgcccagaagatataccagtacttgagaaacagtccaggttcctgaccacggactccagagagaatggagttatttaggtgtgtagttccccagggatcagtcacctggaaactggcctctcctggcagcaatgatccttggagaccagctccaacttctgcctgaccaagccttgcacaggaggctcctttcccaccatcaagctctctctcttcatcctgctccccccactggccatttcccagccctgaccccatcgagtggtcaccttgcatgacccatacatttcctgtagctgtcctcaactctgccttagactaaaagactcaatttcagatcagctctccggactcagtttctctggcctcctggacttgggtttaactcccaaagtggagatcccaactggaaactttgtcacagctttccctaaaccctgggggtttctgttcctgattttctccaaaccctctcattccccctgctgtccaaaccttactcatgaaaatcatttttctcaattgcctcatccaaggtttccgtggggaaccaaatctattcctcataactgtgtggtgagctttaaacaaatatccacagtggcattacaataatgtccaccagacacagctccaaggggatgggtggaaacagagtcggtgagaatgtggtttccaacatcaggcttttaagtgcctaagtatcttggtgagtggttaaaagaaccttagctgtttattttacttctccctcaagtcaagttgaagacttcttgcctataaaccatgaagatgcaaattactgtggccattttgtgggctttcttattataaaaaccacttgttttcatgacggttcatcatgatgctattttgaaattttaggtgaaatttttgataaactctcaccattccttcttatgcaaatggaattccgctgagtttgggaatgtcaatcctttttcctttccctccgaatctcactctcctctgtcaaagaagcactggctccaaatagctcctttcaccgaagagctaagatgatggtgatgggatgtcgtctagttcttaggattcggccctgcctgccaggaaggctaccttggctgagggtgggtgtgggtggggcaggactccggtggacatcaccctcaggaggtgtgtccttcagtagaaatcaatgtcatcaggggtgaatagagcggaagatgtcagcttcctcttccagtccccacagctgtgagagtttcagtatgaaaggtctgtctcccactgccccatcccatgtccctacactgcagaagactctacgggctgaggtctcctaactcatcaaatctcagtttcttcttcccttggtgtcactgggcatcacccaaatccctcgctatcctaaaacggcttgcaacagaattgcatgttcatgaagttggactctctacccattcacatggcttgacatctgctcatttcactttttcacattttctctatcaggagagcgatgagggaaatcaaaggaagggggaggggagggtaagctttaactttgccttatttgggtggttcaagtatgacagcaaaacagtcctctccacctccagtgccctgtgcttattcagtctatcttgtcaggaataccatacactacagacagacctttaggagttgctcagattttctccaagtctacttcaacagcaaaaaaacaatgaaggcagcaatccataatgcagtgggttctcatctgaaagaagattggattcacctgaggagttttgaaaaaaatgccaatgcccaggccccattccagacctattaagtgggaatctatgggagacagtgtcagactttatttttttgggctccaaaatcactgcagattgtgactgcacccatgaaattaaaagacgcttactccttggaaggaaagttatgaccaacctagatagcatattcaaaagcagagacattactttgccaacaaaggtccatctagtcaaggctatggtttttcctgtggtcatgtatggatgagagagttggactgtgaagaaggctgaacatcgaagaattgatgcttttgaactgtagtgttggagaagactcttgagagtcccttggcctgcaaggagatccaaccagcctattccgaaggagatcagccctgggatttctttggagggaatgatgctgaagctgaaactccagtactttggccagctcatgcaaagagttgactcattggaaaagactctgatgctgggagggattgggggcaggaggagaaggggacgacagaggatgagatggctggatggcatcaatgactcgatggacttgagtctgagtgaactctgggagttggtgatggacagggaggcctggggtgctgtgattcatggggtcgcaaagagtcggacacgactgagtgactgaactgaactgaactaatgggagacaggtgaggccaggcagtatttttttgcaagctcccaggtgagtctaaagtactgctctagtcagtcagtcaagagcagtggttctcaaacttagcacacatttgtatcttttggacaacctgtgagtcccagttagttgcacttttgacaagtttccaggtgatgctgatgttgctgatcctttctctaggacaagctttgagaatccttggtcaagagattgagataaaattctaggtgtgctaattctccataacatttccagacaaacattttcaggagagggccatatgataaatatttatagactaagcagtgtgccaaatgaccccaactttagtcttttgttgttgttaggaatctagttctctttttattaagttaaacaaagcaaagtgcaaaaatacaaaataatatggctcttctcactatggtttttttctgggggggggaacaattattttcacaataaatactatataaatacttaaatataaaataaataaatatttctagttttgtcatccacacggtctctgttgcaactgctcaactctcccattgtagcatgaaaacagccataaataatgtgcagacaaatggcatggctgtgttccaataaagctttatttagagggcttggaggatttgacctatcaaccataatttgctgaatcctgttgcccagttttactaccagtgttatctaagagaggatttctttttatctagcttggtgttctttaggctctctgaatctgaggattgataactttcagttcagttcagttcagtcactcaaagagtcacgtctgactctttgcaactccaaggaccacagcatgccaggcctccctgtcgattgccagctcctggaacttgctcaaactcatgtccattgagtcggtgatgccatccccatctcatcctctatcctacccttctcctcctaccttcaatctttcctggcatcaagatcttttccaatgagtcagttctttgcatcaggtggccaaagtattggagcttcagtttcaacatcagttcttccaatgaatattcaggacttatttcctttaggatggactggttggatctccttgcagtccaagggactctcaagagtcttctccaacaccacagttcaaaagcatcagttctttggtgctcaactttctttatggtccaggtctcacatccatacaaagctactggaaaaaccatagctttcactagatggacgtttgttggcaaagtaatgtctctgctttttaatattctgtctaggttggtcatagcttttcttccaaggagcaagcatcttttaatgtcatggctgcagtcatcatctgcagtgattttggagcccaaggaaataaagtctgtcactgtttccattgtttccccatctattaactttcaacagaactgtaaaactcatggttattatccttgtgaatattgcttcttccacatcgtttctgttgtctgttcatgaaaatctgatctgtaacatattagatcctctcagtttatcctccatgtctcttaaccacttttatactctctacttctgtttctctgtgctgcattcatatctttttttcatttcaaatggtagtttttgtctctttatcaaatccacctgatgtgttttgatggtctcttatatcttctcatatattcagttatctcatttattgctttaaggattcttatgtaaactaatttcatattctgtgttgatattttcagtatctgtgatcttttcaggcctgatgttatggtttatgaattctttcaattttcattcatgctgacttatttttttcatgagtctcatgaactttgacactgagctcatattccttagaactttatctgtgatcattctttgaggcctatacggcattgcatttgtttctgtcaggtgccttggcatactctcaacttggtattattttaaataaattgcttgctttagagattcccacatagtatgaattttggcttactgttagaaattcttgggcttccctggtggctcaatggtaaagaatccgcctgccaagcaggatatatagattcagtccctgggtcaggaagatcccctggaggaggaaatggcaacccactccagtatccttgcctggagaaccccatggacagagaagtctggcgggctacagtccatgctgttgcaaagagtcagacacaattcagcgactaaacaacaacattagaaattcttaggggataattctttccagctccattcagagccaaggtggagacagaacattccctcctgcgcccctcttttattctgcagttcagtttttaggggttgccctttggtggtctgggctttatgtgagagtgtcccagtcatcaccctgcctgtccctggtgtctacatgaccccttataatctgaacttgatgctgggaaagattgaaggcaggaagggaagggtgtgacagaggatgagatggttggatggcctcaccgagtcaatggacatgaatttgagcaagctccaggagctagtgaaggatagagaagtctgtcatgctgcagtccatggcccctaaaaagctggacatggacacgattgagtgactgaacatcaacaaggccaccaacacggacctgggactccacaggcaactgctgcctccacttcaattctccttcctggactcacgctctctcaaggcttctgatctcccaggaatcccttgttctgtgcatgttcagctgtgcttcacaaacattattttaattaatatcatttccagcaatgtaagtggtctacttaggagagctgtcaccatattgtcagggacactgataggcaactacttccaatttccactttctcatctctcagtggagaagccaacagaactgggactcagttcatttttataatgaatggatcagtgatttttatattattctcagcagtcttagtattatagtatcattatgctactgtgcagtttgaggacagattaatgaaatattcctcagattagaccaggttggttactcacatgaatctgtttcctaggaccttttttaaaagcagctgtatgggattcatgaacctatttattctttgaagttttgagtttccctgtgtgattcagaagacctacagcaagttgaaatgtgttattctgctgaggcattgatataaaccagctacacattgaggctcatattggaaactaatcatttggcttcatggatgtgctcagctcacaagctcacagtatcctcatcccagggcagtgtgttgatctcctctccttgacttacactataaagtaagtcttttgaaattatagaaaagcagaaagtcactttcttggtgtaaaaaatagtcaccaagtaaaagctagacattttttaaaagtcaaaaaggaatttagattgtggtgcacacggacatgcaggaaatgcaactccctgtggacctgtggttcaggaagatgccaggagcctgaagaaattttccacattcttgaaatggggaattctggaagaatcaagagtgtcatctcattaggatttcaagtgcctactacagactaataaataggtttgtgaaaaataaagttaggcagaaacactattaaaaagagtctgcaaactttgtcactttcttacaatactcttaccatatgatctggcagtcaagatccatagtatttatccaaagcagttgaaaaaacatatctatgcaaaaaccctgcacaaggatgtttacaacagttctaattgccaaaacttggaaacaaccaagatatccttcagtaggtgaatagataaacaaacaggtacatccaggcagtggaatattactcagcaataaaaacaaatgagctgtcaagccatgaaaagacaagagaaatcttaaatgtatattattaaatgaaagagactaatctgaaaggactaacaccacatgattccaactgtatgatatggtggaaaaggaaaaactgtggagacagtaaaaagggataccagggattggcgggggggtagtataaagagacattactttgccaacaaaggtccgtctagttaaggctatggtttttcctgtgctcatgtatggatgtgagagttggactgtgaagaaggctgagtgccaaagaattgatgcttttgaactgtggtgttggagaagactcttgagagtcccttggactgcaaggagatccaaccagtccattctgaaggagatcagccctgggatttctttggaaggaatgatgctaaagctgaaactccagtactctggctacctcatgcgaagaattgactcattggaaaagactctgatgctgggagggattgggggcaggaggagaaggggacgacagaggatgagatggctggatggcatcactgactcgatggacgtgagtctgagtgaactctggaagttggtgatggacagggaggcctggtgtgctgtgattcatggggtcgcaaagagtcggacacgactgagcgactgaactgaactgaactgagtataaacaagcaaagcacagagaacttttagcacagtgaaactattctgtatataatgggcagtaatactgttttggtggatatgtgttatgaattctttgaagccaatagaatatactaatacaacaccaaaaccaaaccttatgtaaactacggacttccagtgatgatacgtcagtgtccgctcattgacggtaataaatgcagaaatctggtaggggatgttggtcattggagaggctatgcctgtgtggggacaggggtttaaagcaactcttttaaccttctgctccatttttcattgaccctaaagctgtacaaaaaataaagtttatgcttttgaactgtggtgatggagaaggctcttccactccagtattcttgggtttcccttgtggctcagctggtaaagaatctgcctgcaatgcgggagacctgggtttgatccctgggttgggaagatctcctggagaaaggaaaggctactcactcccatactctggcctggagaattccacggactatgtccatggcgacgcaaagagtaggacacgactgagcgactttcagtttcacttgagagtcccttggacagcaaggagatccaaccagtccatcctaaaggaaattagtcctaaatattcattggaaggactgatgctgaagctgaaactccaatactttggccacctgatgcagagaactgactcactggaaaagaccctaatgctgggaaagattgaatgcaggaggagaaggggatgacaggggatgagatggttggacggcatcaccaactagatgcacatgagtttgggtaagctccaggagttggtgatggacagggaagcctggcgtgctacagtccatggggttgcaaagagctgcacacgactgacggactgaactgaactaaaaaaagaaaaaaagaacctgcaaaatgccatgagtttgtatcccagctgcttcttcagaatagctgttactgcctggcaaaaactgcccacctgaaatcacctatggggtctaggccaaagtgactgcacctccctgggtgtgtctgcctggctgagagagtgagtgtgggccctgcaatgctggccagagcaaccacatcttggggcttagagcctcctccaggggcctgggacatcccctgtgcagagggatttaggccctctggcattttctgccttcccaagtgtcccaagggcggttttccgggaagattggtgtgctgggcaaaaacccacacctctgggagaatctcagtgaggtgaaagaggctagaaggacagttaaaaggttccacacctctggcagctcttggttcctagtagaaagcaggatgtgctcatggagacacaccagcacacacacgggcacgtgcacagacttcgccggattgacagacttatgcagatccacgtccatggcaacacctgcgcgggagtccacagtcaccatatagagacacacacatcatccaggcagcatgccatgctggaaaacaagcagtggctcttgcagaacatgctctttctatcgcctggggagtgaactgtgctaacacgtgccccctgggaatgcagcagccttccagaacagtcagctctccttcctcccgtctctcagctgtgtgagctcggccaacacctggaactcccgcgaggttcccggcggatgcacacgtgtgttcatctcagtctgtctggcgagagggcagtgcggggcagggactttccgcctcttgcaacttcaacgcccaaggcagggctgtaattcagggttgtcagtggatgacactcaagtctgcccacgtgacattggaggtccttggtggcaagaacatgctgcctgcagctgcctgagaggatcaatagccggagacccaaagggatggaatcacatggggtcagaggaacatttgtttctctcccttgggcccagcagcaatgccttcttgacttggagcctgactcggagttgcataagctgcctggagaaaccgggtgtaggaaggtgttttcagtagtttgggacacttctgactcgaggctgcacatggaagaggatcttctaagtggaaacaggcccatatgctcattggcagatggaatccaactggatgtggaaaaaagctcaacagagggctcaaacctaacaaaaaaaatcaagtgaaacaacaccatttgagtgtaacgaagacttaaaacgatgttagaaacatgtctggtactagtagatagtttgaaaaagttagtttaaaaatctttctgttgagttgaaaagcaggaaggctttcagtacttccattcttttaaaaccctttacttttaaacataatagatttgttttcttttaaaaattgttttgttgaactcttttgcaactgtggtagacagaataatggttcaaaaagatgctcacatcttaatccatggaacctgtgcatacatttccttaatggcacaaggggctgtatacctgtgatcaagttaaggattttgagatgaagatattattctggattagctgagtgggtctagtgtacttacaacagtagtttgcagttttacagagggagatgggagagtcagagtctgaaaggagatgtgaggatggaaacaaaagttggagtgatgtccttcgagggtacaggaaggggctacagcccaaggaatctaggtggactctagaagctggaaaaggtaaggaaatgtgttcccttctgcagcctccagaaggaatgaagcctgggctcaattttaagatttctcaactctaagataataaatttgtcctcagccactaagtctgtgttaagaaattaacacaagatgttgtgattggtcagatcctgcatgctagcttgaaggagaactgacttattgacaaataaattactgctccatctggaccttcatacagtttccttggctgcgttcctttgtttgggtgaacttagggtatgaattgcttacatgcttttcagtatgctaaatgaaaaatcaatgttaagaagtttaaatctctatgtcttgttgaggtttgacaaaaaccataaaattctgtaaagcaattgtccttcaactaaaaagtaagttttttttttttttttttaaagtttaaatctatctgtatctgattacagagatcttctattcatctttgttggggattatcctcctgtattagttgtctaggactgccgaaacaaagtaccacagactgaggggcttaaacaacagcaaagtattttctcacaaagcgtgacaaagcatggtccactggagaggggaatggcaaaccagggcttcagcacctgagtttgctggagggacatagttcatcccataacatctatactgggtacctgtgggacagggtccatgccagtccatgccagttgttctagccaagtagaataacatgtgcatactacttgagtgacatgtccagacttctgtctataagtccatgctttgttccacgtttgatacacctgaatgtaccacaccgtgagtgtagttggaactgtatcaccttggcaccttctgacacacaagaaaatgtgttctagagatgattacaagaagacagggacaggccagctctggagtggcaaaaactatctcagaaaaatctcatgaggttgggaagtgggggagacaagggggaagagtgaaataaatgcaattagatccctacctcaaaccatacacacacacaccagacagattataaacctacatgtgaaaaattattaaaaaataggacaacagctacatgatcttaagagtagagaaaatctttaaaaaaagaatttataaatccccaaacaataaagaaaaagatatgttcacatgcttcaaattttaaaacgctgtacagaagaacctataaacatgtattgacaaaagattaaaaatgtactgggagacgtttaatagactaggaattagtaaaacacataataaggaaaacaagagtaggaaaacaaatgaattgtccaaagaggaaatgtgaatggtcaacaaataaaaaacaaataaacaaaaggtgctaaaacacagagaaggccaataaaaagaacaaagagaaaccatttcctagccattgtatttgtaaaattaagtaatcagtctgtctcaactgttaccaagtttataggggaaatggtaaattgttgctgaaaatgtgaattggtaaagacattttggaggaagtttggtgtacttagaaaaatgtgcttgccctgtggcctagaaattatgctctgggatgcgcaatagacaatcttctgagtagttcataagcaccctatatgcagtggtgtctgttatgcagtgatccccaacttttttgccaacaggggctggtttcatggaagacagtttttccgtggacaagggtgaggtggtttcaggataattcaagaacatgacatttattgtgcactttatttctattattattacatcagctccacctcagatgattaggcattagatcccagagattgggctcccattgtacattttaccttgtaaaatgtaaacaatgttacaacattgtttgaaacagcagaaaaaagggaaatgatggaaatacccctcaatataggaataaacaaatagaatgtgatattttcccacaatgaaataccataaagcaattaaaaataataaagctgatatatatatcattattaaaagatcttaaaaacataaggtagagtataaaaaacaggatgcagattgatgggatatatgaagatgatgtatgtttaaaaaacacaaatgggagatattcccctggtggtctagtggttaggatttggagcttttacttctaggcctgggttcagtccctcgtcagggaactgagatcccatgggtcatggcaaaaaaaaacaaaaaaaaaccatatacagtgtgtgtgttgggggggtggggactggggcattttaatggatgaacatctacctagaaaattgtttttaacagaagggaatgatacatgatcattttagtctctaggggaatatgggaaggagtggatggggttgctggtttaggggacactagctaacattcatccttgaatcccccctccctgttctctgccttccctccttccttcctttctttgttcttttttttctctaaaagttgacaagaagtaaatatgacaaaggcactcccctgatcgctcagtgggtaaagaatctgcctgcaatgtaggaggcacaggagactcaggtttgatccttgggttgggttctatcctgggtcgggaagatcccctggaggaggaaatggcaacgcattccagtattcttgcctgaaaagtcccatggccagagaagcctggagggccccagcccatgggatcgcagagtcagacacaactgagcatctaagcatgcgtgcagacgtgacaaaaagttaacatttgttaactctaaattgcaggaatatggaagtttaagttattccataattttacgtaatttttattttttaactttttattttttattgtagtataatttattaacaatgctgtattagtttcaggtgtgcagcaaagtgattcagttatacatattcttggatctgttcttctccaaattcttttcccaattaggttgctacgtaatattgaggagagctccttttactataagatagattcttgttggttatccattttgaatatggcagtgtattcaactttgaaatctctgaaagcagaaaccaaaccaaacaaaaacacccttaaatgttatacaaataaacaaaataataaactattaaagctctggttaagggaagtaaggctttcctggtggctcagcagtggagaattcacccaccaatgtaggagatgcatgttggatccctggatcaggaagatcctctggaggagggcatggcaaaccactccagtattcttgcctggagaatcccacggggatgaagagtcggacaccactgaagtgaccgagcacaccagggaagtaaaggaaacaaagtgtgatgctgcgtatgctgtgttccggagaagggagcgattcctcacagttgggagtccccactggcttttcagctggaaagtaccatatagacattcggagctgagcccctgttctacgtcccttgtgaatgacctccagtctcctgaaacacagtggtagggaatcttcctccagtgccagaaactggctgcagtgttctgaagcaggtggttccatttttcagtagcttaaatgattaaggcaaattcttatttctgaaaagaattctattctgtagactctgttctttgggtttcacttcttttcttttttttccccctggagcagcagagattaaatccagtgcccctttaacagaaaagtctttcaaaatgtgtagacagctatcccacatttataagtttttacatctaatcatttaaagggcttttaacacaaatacaaacatgcaagcgccacatggagacattgcagtaaaatacaaataggctgagaaattgaacttttaaaattctctttaagaacatggaagaaactaacttgagaacacagagatcttggtccatctcggggaatgaatttttctctggtcttacaggcaaaggggttcccctctcaggagggagaagaatgtaattgatgaccaatccttatcacacctgaaagggcaagaagtaaaggggaactggatgactggttaggaatgatacttcaacagacgtaagtggaagtttattatctcctttttaatgacattgtatatttgatgagagtagcaatgccttgcaaacttcagtgcccatgtgagctaagaaagggatctaaatgctgactttagaaagttaatcttaaatgcaaaggcctctgaagacacgtcccccactagattgatgtttattgcttggtttctttctgaaaagtctttgaaaagtgaccaatggacaagagagcctggtggcattcagttggagagtttattggttgacattgttcaagttacctgagacgctgtatgtcattttgggtaagaggaagaagggaggaaagaatctgaaacttaagttcccactgttagtagtggaacaaggcttccaattcaagttcttcctggaaaataactgtccctcattttatttacttttgtttcaaacctcaccatctcaaagagactgaaaccgcaatagcaataacacaaatatttaatgactggtttcatccaatcaaaatggactatggttgctatgccctctggggatatcctggtcgaatacctgccctgttctcagctccgatcagtcagaccccgggaaacccttctgaaggtgaaacagagcaagtgaagctgtctttgtctttgataaagcggctttatggcattccctgaagttacagtctatgtgttaaaatgcttctttgtaaagcctctctttagaaatcacttccgtctgcagaaggaaataaaggagatttattttccctttatggggaaggagtggtttagagtgactctattttgggttgactgacaaagctcattccttctcaaaggtctccgggtggccagaactaagagaagggatgtagcatccgttctaacactctcttcaaagtcttccacccccatggttccacctttggagaaatttcttctcaaaaccccatcctcacgctccgcttgccaccatcttactttccaagtcatctcgatgccacgcccagcatgttgttttcctctcctttcagccggttccattggcccctccctcccgtggtaaatccatttcctaatcctgacatctccccagggtataaataaatctttaggtggtggttccgacacatcatcccataatccgggggtgtcatgaccacctaggatggaaaagtaatttcataacgattccctcactcttcccctgccccctcctaattgctaatgtttatttttgactctagacaattaaaatcagttctgtttggaggatttcacaacactcctcgacatttttgaagatgcaatggagaaaaactgaagagagaatgaaaacctaaggtctgtgcagcatctcccaagttggtggggcttttcctcttggttgtgcaaacccagtccagtgggatagagacatgactgccgcaggaaatgcatttttctgttagccaaaaagcagtgctgttgaatggcttgatagaccacaaaattacattcctccactcaccactgggaacaaatgtaatgggaaagtatattaccaatttgcatcacctgggttcactacagccagaggtaaagaggttaatccaacccactcacttatttgtactggattaatttgctgtgagtgttttggagtctttgtgctatcttttgattcaaccacataactgatgaaattaagcactggaggttgcctggcttcttagttttgaggccactacctctagaacttgcatcattcagattaagaaagagattaagctaatgaggaaaattctggactgagttcgccacagacataacatttagtgtcagtccaacactgaccccagtattctaggtgcatgaagactggctggcttctcaagaagttccatgggctggtgcccacttaagtctgctctccaaagctcaaacctcagtaattgtaaaaacttattggaaatacttgcaatattttcaagttgaaaatatgcccatatattttaaacaatcccaaagggatcaagaatgggggaatggcagggctgggtaagaagcagcctcgtgctgaaggcccaggagggagagtgccaatgtcagactattggatgagatttctgagcaagaaccaaatatttcagtcctccggcatttgtggaaattattttagcagggaacagcaatggcactaagacaatgatttgttttctcaaaatccaaattaagaaattgtatggctcggtgtttaccctctaactaagaatttaaccttttctttcaaacactgtgcctgaattatgagaggtcagagctctatatttttaaatggcaggggggggtcttaaagaccccccgaaattgcttggtaatagatcagggatctccagcctcagataacttccacatatataaattgcaagccagaaggaggcactaaggagaagaacggaaaggcttgtttggagagcaccacaaataattataagttatgggaacagagaagaaaataaaacatgctgattagaaacatcaggatgaattggcattgattttgctgtatgatagaaaatcggtttcaattttttttttccaacagatgcatagcatggtgagtgaggaattaaattttattccaggttcaaatttaagtttggaaatgaaatttgggaaggtaagcctcgtttcacagaaactaagcaactttctgaatactcttacataaggtatccaagagacgactgacttgattatccagtatctgtagcctcagagaaattattctcttgcttttgagtttcagtgcatgtttagtccttgtttattcatttagtgatgctttctaacattcttttctgtgaatctttgcctgttctggttctgtcttctcatctctgagaaaaccagaactggcaataaagcccttgcttgttataaggctgcagaatgtgtcaaagcatccattctgctcagttcaattgcttctgttaatttctctttacttgttgttgtttagttcctaagtcgtgtctgactgtttacaactccatggactgcagcacaccaggctcctctgtcctttattacctcctgaagtttgctcagattcatgcctattgagtcagtgatgccatccaaccatctcatcctctaccacccccttctccttttgccttcagtctttcctagcatcagggtcctttccaataagtcagctctttgcatcaggggtcaaagtattgaacttcggcttcagcaacagtccttccaatcaatactcaggattgattcctttaggataggctagtttaatctccttgctgtccaagagactcttaagagtcttctccagaattccttaaaaaactggaaatagaactgccatttaacccagaaatcccactgctgggcatacacaccaaggaaaccagaactgagagagacacgtgtaccccagtgttcatcgcaacactgtttacaatagccaggacatggaagcatcctagatgtccattggcagacaaatagataaaaaagctgtggtacatatacacaatggagtattactcagctattaaaaagaatgcatttgaatcatttctaatgaggtggatgaaagtggagcctattatacagagtgaagtaagtcagaaagaaaaacaccaatacagtatattaaagcgtatatatggaatttagaaagatggtaatgatgaccctatatgtgagacagcaaaagagacataaatgtaaagaacagacttttggactctgtggaagaaggcaagggtgggatgatctgagagaatagcactgaaacatgtatattaccatatgtgaaacagatcgccagtccaggtttgatgcatgagacagggcgctcagggctggtgcgctgggatgaccctgacggatgggatggggagggaggtgggaagggggttcaggatggggaacacatgtatacccatggctgattcatgtgaatgtatggcaaaaccactacaatattgtaaagtaattagcctccaattaaaataaataatttttacaaaagagtcttctccaggacctcacttagaaagcatcagttcttcagtgctcagctttatctttagagtccaactcttcacatccgtacatgactactagaaaaaccatagctttgactatacagatgtttgttggccatttccctttaggttcttaataattggagtaaatacaaaggtcacatgaatattttctttctcctttttagtgaagtgttggttaccatcatcaattctgtgtcttaaagtatctgtttctgaaagtaacttgcgggctaactttctcctcagaggtacaggtcctgtgatgtcatgactgggtagacctgtcacttgaccagccagggctgcaagcacgttcctggcctttggcagaactggcagatgggcacagcctctgggtttggtcatggctgttccctctggcctcctgagaatatctgtgtgtcgcaagagcatctgtcctcaccccaggctccactggcctcgcctggaaccataccacttaaaggccattcagacctcacccagttggcctccctctgcccaaatcttcaacataggctgatgttaagtgttcccgtgtccctgctcccaagcctcagaagatcctgctcgtgggtgtctgtttgcaaggtggtcttgggaatctctgcagggttggtgatgaagtccagggagtgccagccctctgcccagggcagctgctcctaccctggggctcctctgagccccccatgcccttgccaccacccatctcatttgtcctaggaggagacaggacaacccacgagaagacaagcaccatgaaagctcatgcctgggcttaccgatgccccctggcctgaacgtacctgaaccatgcctgaaacacccgctgcactcagaaaagtgttgtttcacatgagatgagccttccttccttctttttacctcttcccttccttccccttggaaaagaagacatggcctctcttccagtcaaggaggatctcacctgctgtgccagtctctcctctagaatcctagtccttatttggtttccttcctagaattatcaatgtcaacttcttcttagcctgagcattatccctcttcaaatgacattcttttgatacttctcccctttcccaccattccatactcaaggttgacaacttgttcttaccagggtaaataaaaatgctaccactcagagaagggacaggcaccctcataaggagctaagaggatactacatgaagggacattggacagtggctttgaagtgttcagaattagttttcagcattaaaaaacaaataagatatttcagctaccttaccctagtagctcagatggtaaagcatctgcctacaatgcgggagacctgggttcgatccctgggttgggaagatcccctggagaaggaaatggcaacccactccatactcttgcctggaaaatcccatggaccaaagagcctggtaggctatagtccatggggtcgcaaagagttggactcaactgagcaacttcactttcacttttctttcaagatatttcagctaagaatcagatttttgcaggctgcatatgtgctaaactacttcagtcatgtccaactctttgctatgctatggaccatagccagttaggctcctctgtccatgggcttctccaggcaagaatactggagtgggttgccatgccctgctccaggggaatcttcccgatccggggattgaacccatgtctcttatgactcctgtactgggttctttaccactagtgccacctgggaagccctttcacaagttactcctgaaaaattagatctgatcatgccaggcttatatgtccacatctcaactgtccctttccagaaggtcttgcacccaaacggatgccacatgtgtcatatcctgcatgttctcctgcaacgtggtcttgccactctgccaccaagagatggggtctgattcctctcgccttgagtctggagagaatcttgtcctcggtcacttgcttgcaaccagtagaatacggagggaggtggtgctgcatgatttctgaagccaggaatgcccacagttcaccagagagaggatctgcttccatagctgccatgtgtacatgtgtaccgagatatcatcagtgacataatccttgtgggcagacaccctctctggtccctgtttgtgttgttgttgctgttcagtcactaagtcatgtccagctctttgtgaccccatggggtgcagcacaccaggcctccctgtcctttaccatctcctggagttcgcccaagttcatgtccattggattggtgatcccactcaaccatacactctgccaccctcttctcattttgccttcagtcctttcccagcctcagggtcttttccaatgagtcagctgtttgcattcattccagcatcagtccttccaatgaatattcaggactgattttctttaggattgactgatttgatctccttgcagtccaagggactctcaagagtcttctccagcaccacagtttgaaagcatcaattctttggtgttcagccttctttatggtccaactctcacattcatacatgactactggaaaaaccatagctttgactagctaagagtttttctgctgaacatgggtgtgggctgttggacttacgggtggagagagggaaagactgagctactgaccactcttcattctgtccttctatctccaagatctcacctttccccacaaaaccactgcaactgtctcaacaaaacccacctaagcttccccaccatccatgaaaaccacactctgaaagacagaaccaggcagagacaagagaccctttgttgatgaagcatttactgccatatttttgagagattaataggcatcaggatatgaagaggggctagatgcaaataccttccataagaatgtatttaaaaacttgattgcaaacataattcacattgactacagaaaactcagaaacacaaagaagaaaattaaaatgtcttctctcatcacacctagatataaatatcttatagatattcaggctacatccttctactttattttgtattcctataaatggaacaataatgttccaaagttcagattttgttgtaaccccatgtcctgaatattgtacatattttcccatgttactaaatattcatgtacagtgtgattttatatatacttttatacacagtattctatttatgaagtatcttaatttatgttatcatctcctattatttgatattaagttatttccagttttctcttattatccataacacggaagtgaacaaccatccttgtctacatatctttgcacttgtccttgattgtttcctgggtaaatgtctataaatgggatcactgagtcaaagaaaccatattttcaaggcttctgcaatttattgccaacttatcctctagaatcatgttcttaccaacaggagtgtccatttcatcagatctataccagatggaaaatatcttcttatgctttggcaaatcaacagttctagtactttggattcaacaataatttgccaatagacagtgacaaagcacagaaaatgaaacagaagaaatctctgagaatgcagaatgtctcctttacagaggaggaaagtgggacccagaaaatgaagtgatttgcccaaagttatacagataattgatgggtctctcattgacactggtcattgcagcacagtgaccaattctggtcgctgtgttggatcagtgagctaatgactaatctaggctttcctgacctccctttgccccttccattttaaagaattgtatttaggcagctgcccatactggtggctagaagttctcttggacccccaaacagtgccaaatcctctccatgtttgcttttcagtatatattctgtgtctggtcaaacttgctaacaatgagccttgtttcaggttcaaagaagggctaaacggcccatgaactagagtagcaatcttcctaaagaacagccctgaccgctccccccccccccccacacaaagaagagtcctgtcctccccgaagaagagtgcacacaatggtatctattcaaattcaagatgcaggacacgctgcagacacaagcagcttggaaagttgagagaagcactgtacatctagcctctgtcccttgaaagctcactgccccattcctcatagcttgctcatgcaaatctggctcatccctggttcttaaggctctagtgtctacatcatagtccacactttgtggaccttctttctgctctgattactgtgatacccatctctctttttcttagtttttgtcctaccttcttatgtctattgcaagtctctggcttttccagtagtcacatatggatgtgagagttggactatgaagaaagctgagcactgaagaattgatgctttcaaactgtggtgctggagaagactcttgagagtcccttggacagcaaggagatcaaaccagtcaatcctaaaggaaatcaaccttgaatagtcattggaaggactgatgctgaagctgaagctccaatactttggccacttgatgcaaagaactgacccatttgaaaagaccctgatactgggaaagattgagggcaaaaggagaaggggcaacagaggatgagatggttggatggcattactgactcagtggacatgaatttgagcaaactcctggagatagtggaagacggaggaacctggcatgctacagtccatgaggtcacaaagagttggacatgactaagcaactgaacaactctttcttttagccttaaatatgtggcagacatctcaaatccttaactcagaaacatgcattctttttaatttaaaagaaaacccaaattgattttaccttccactttaagatcctgttttgccagatggtggaaagtgaaatgtcagtggcctcagggtggtctcacatccttactcgctgccctgctccccctgctctgggacccttgttccttctgcggggagggggctggcatctgttcattcctcatcattttccaagcacactggcacacctcgaggcttccgtcactcctgtcaggcctctgtcctcagcagtgtgtgtcaccacagtgtcctcctgggcccccctgaactcttgtcaaaactacctctccattcatctcaccctctccttcctcccctcataggctagcgtatgtaaaatatattggcaacgagaatttgctgtatgactcaggaagctcaaacaggggttctggaacaatctagaggggtgggaaagggtgggaggtggaagcgaggctcaagaagaaggggacatttgtatacctgtgactaattcatgctgatgtatggcagaaaccaaagcaacgttgtaaagcaattatccttcaattcagttcagttcagttcagttcaattgctcagttgtgtccgactctttgtgactccattgcctgcagcatggccaggcttccctgtccatcaccaactcccagagtttactcaaactcacgtccattgagtcagtgatgccatccaaccatctcattctctgtcgtccccttctcctcccaccttcaatcccagaatcagggtcttatcaaatgagtcagttcttcgcatcaggtggccaaagtattggagtttcagcttcagcatccgtccttccaatgaatattcagcactgatttcctctaggatggactggttggatctccttgcagtgcaagggactctcaagagtcttctccaacaccaccgttcaaaagcatcaattcttcagtgttcagccttcttttaatccaactctcacatccatacatggctactggaaaaaccatagctttgactagatggacctttgctgcaaagtaacatctctctttaaaaataagtaaataaataaaagatgctggctctctgtccatcacctctgtgctactctgggcagatgagaaacatctagttactctcagaactaatgtgggtatggggaaattgtgctgtaggactggaccatctgcttggtgacatggaccccatttctgcttctccagtactcatgcttggaatggaagtaccttcctaggctcaccccttttaggaatcctcttgggtaggatcctagagaagaacagtgcctcacacatgaactcgctgtgcctctgggacattgctgtcattcctgtccccaccccatgccccaccctcatcatcacgcatcttcactcccacctcgcaccttggctggatcaaattaaaaattccgaactttggaatgccccagtttacagaatatgagaaatagctggtgagcagaaaaaggaatgtctggaactaaaagcattactttttctttaaaaaattgaggtatatttgacttacaaagtgttaatttctgcagtagagcaaagtgattcagttatacatatgtatacattttaaaaatattcttttccactatagtttattgcatggtattgaatacagttccctgtgctctatagtaggcttttgtagtttatacattcaatacgtaatagtttgtatctgctaaccccaaactcccagtccataccttccccactcctcttcccttgacaaccgtaagtgcgttctctgtgtctgtgagtctgtttctgttttgtagataagttcatttgtggtgtattttatagttcacgtataagtgatattatatggtgtttgtctttttctttctgacttacttcacctagtatgataatctctagttccatccatgttgctgcaaatagcattatttcattctttcttatgactgagtaaagtattccatttgtacgtatataccacttcgttatccatttattcatcagtggacatttgggtggcctccgtatcttggctattgtgaagagtgctgctatgaacataggggtgcacgtatctttttggattatagttttgtctggatacatgcacaggagtggggtgctagatcatacggtaattctattttttagttttttgaggaactgccatactgttttctatagtggctgcaccaacttacattgccaccagcagtgtaggagggtttccttttctctacaccctctccagtatttgtgatttgtagactttttaatgaccattctaactggcgtgaggtggtacctcattgtactgttgatttacatttccctaataattagcgatgtggagcatcttcttatgtgcctattggccatctgtatgtcttctttggagaaatgtctaaaaatgctagaaatcacatcacatcatattatttaatccgtcacaccattgttgtgctacccatacatctattgtcaaccctcgatactcaaattccttctgagcttgtccccatttagctctggtctgtgctcacatcatctttccatagctcggctctcaacagccaccccagatgtgatggtggcacctcacacgtgtcatggccaaaacagaaatcagtttctacctctcttatttcatttactccaacagactaagactacaccccactacccatcccttttgactccctaaggtccaccctgtcaccctgcttcttcctgccaggaacttcacctgaccactctgttgctcagtaatggcattcttctcaagtcctagagcgctcactcattcctcgctgagcacgcactacatggtactgttgtttgatgagatcattgccatctaaggggcagagactctgcctctttcactgctgtgtccccaggacctggtacaatgctgggcacacagtaggtactcaccagacattttcttaatagatgaattctgttaacaagttttcagcctcagtagaaaaagctgtgtcttacacctctagagaagcatggagtctgaaaagttcatggctttgaatgaatctttgcacatgatggtggttcagataataaatctgtctgcaatataggagacctgggttcgatccctgggttgggaagactccctggagaagggaatggctacccaccccagtattcttgtctgaaaaattccttggacagaggaggctgacgagctatagttagtgcagtggtaaagaatctgcctgctaatgcaggagatgaaggaaacgtgggttcaatccctgggtcggaaagaccccctggagcaggaagcggcagcccactccagtatgcttgcctggaaaattccatggacagaggagcctgatggggtctcaaagagtcaaacgtgactgaacatgcacacactactactttgctcatgatggtgataattaaatgaggaaagggtatagtgcttatcgttgaattgagatgttttaaaaaatttaatttttattggtgtatagtcactttacaatgtattattttctgctctacagcaacagcaaagtgaatcagctatgcatgcatgctaagtcactttagatgtgtccgactctgtgcagccctatggactatggcctgccagctgtccatggaatgctccaggcaagactgctggagtgggttgggttttcttctccaggggatctttccaactcagggattgaacctgccctctcttacgtctgtattggcagacaggttctttaccactagtgcaaccaggggagccctacatacacttatagcccctcttttttggatttctttccatttaggtcaccagggagcattgagtaagttccctgtgctatgcagtaggttctcattagttattttatatatagtagtataaaagtgttttaagttagggaagtcctgataaaacacccccatcactaaatactcaagcataccctatctgggtctgctatattaactcctcccttaacaaaactttgactttgtttattggggtatctgtagtgtaacagaatcattccacatgcatctgaaaccactcaaataatgagcatgcattgagtctagcactaggcatggaaagagaatgaaaaagaaatgaagattatttcaagaaatatgcttgtctcccaaagattttacaatctacttagggagtcaagaaaataacaagagggaaagaacttgattacagagcagaaactcaagaagaaggcctagcagctgaagaattaggagataagaaattcctagagggattaaagaaagcctcacagacatggtggggcttaggttggagcttatgttcctaggtccttggtaacaggagaatgcctttgcaaatattcaagagctttgagcataaagaacaatactatgtgtggttaatcaagtgcacagtttattaatctcataagcctattaaatactattattcttcaaatgccacttacccaaccaataacataaacaaaagattagatctgctagacaaagtgcctgaagaacttgaaggatggaggttggtaatgtacaggaagcagtgaccaaaaccatcccaaagaaaaataaatgcaagaaagcaaagcttatctgtggaggctttacagatagcgggaagaaagaagagacgtgaaaggcaagggagagagggaaacatttacccaattgaatgcaaagttccagagaacagaaaggaggataagaaggccttcttaaatgaattagagcttccctggtggctcaaatggtaaagtgtctgcctgctacgcaggagacctgggttcgatccccggatcaggaagatcctctggagaaggaaatggcaacccactccagtactcttgtttggaaaattccatggatggaggagcctgataggctatagtccatggggttgcaaagagtcggacacaactgagtgacttcactttcactttcttaaatgaataatgcaaagaaatacaagaaaacaataggatgggaaagactagagatctcttcaagcaaactggagatatcaagggaatattttgtgcaaggatgggcatggtaaaggacagaaacagtaaggacctagcagaagagattaagaagaggtggaagaatacacagaagaactatacaataaaattcttaatgacccagataaccatgatggtgtggtcactcacttagagctggacatcctgaagtgtgaagacaagtggaccttagaaagcattactatgaacaaagctagtggaagtgacacaattcagcagagctatttaaaatcataaaagatgatgctgttaaagtgctacactcaatgtatcagcaaatatggaaaactcagcagtggccacaggactggaaaagttcagttttcacgccaatctcaaagaagggcaatgccaaagaatgttcagactaacgtacacttgccagcaaggttcatttcacatgctagcaaggttatactcaaaatccttcaagctagtcttcagcagtacatgaactgagaacttccagatgtacaagctgggttttgaagaggcagaaaaatcagagatcaaattaccaacattcactgaagcatggagaaagaaaagagtcccagaaaaacatctacttctgcttcatcatctacactaaagcctttgactgtgtgaatcacaacaaactgtggaaaatttttaaagagatgggagtccagattattttacctgtttcctgagaaacctgtatgcaggtcaagagttcgaagcaagagttagaactttacatggaacaacagactggttcaaaattgggaaaggagtaagacaaggctgcatattgtcaccctgcttatttagcttatatgcagagtacatcatgtaaaatgctggactagatgaatcacaagctggaatcaagatttccaggagaaatgtcaacagatgataccactctagtggcacaaagtgaagagaaactaaagagcctcatgatgaaggtgaagggggagagtggtttaaaactcaacattcaaaaaacgtagatcttggcatccagtcccatcacttcatggcaaatagaaggggaaaaagtggaaacagtgacagactttatttttttgggctccaaaatcactgcagatgatgattgcagccatgatattaaaagatgcttgctccttggaaggaaaactatgacaaacctagacagcatattaaaaagcagagacatgactttgctgaaaaaggtctgtttagtcaaagctatggtttttccagtagtcacgtatgaatgtgagagttggaccataaagaagcctgagtgccaaagaattgatgcttttgaactgtggtgttggagaagactcttgagagtcccttggactacaaggagatcaaaccagtcaatcctaaaggaaatcaactcattggaaaagaccctaatgctaggaaagattgaaggggatgagagaggatgagatggttggatgggatcactgactcaatggacatgagcttgagcaaactctgggagatggtgaaggacagggaagtctggtgtgctgcagtccatggggttccaaagaggcgaacgtgacttagtgaccgaacaatgatagtatctgtggctttggtagacgcagataggtgttcagatgctctgatgcctgaaggagtaactttgcctggatagccaaaggcaggggcaggaaggggtctcaagggaatggtgctgactttccaagttggtgtccagtttggtcaatgtggcccagatggctgacctcaggtattgggcctgccttggacaccccctgcagggaggggatgagggatctctgagtaaggggtaaaccatccaagatgacaagcttgattctgggaccaggatgatccttaaggtgggtcttctcccttccaggatgaccatggaccaccagcaacagaagcatccatgaaagccacggacatagaaagcctttaaataaactgcaggctattggctgcagtcaggagctcagcagagcctagctgtttctttattaaattggcatcattcctatcattgcctggcttccagtgtgctccctttaggcgagctggtgatgtgcgaggtcccgtctgcctggacaaactggagaaggaaggcaattatgcagataattcaagcaagagcctggctccgccgaagctctataatcacctgaagagcctgtttgtcagaacatctccaatggcacaattcagacaaaaagaattttgttttctggatgattgcctcacccttttggcagtgtgattttagccccagtggaaaactgatatttatcatactctggtcctagagcctgcggaatcaataaacaagatgtcgcgatcgggactggtaacagctccaactgtgcagagcaaaaaaacaaagaaagaaagaaaggaaaaaaaccagagctgattgcacttcctttgcatagctaccttctcgtcctgctccccgcctcagggccaggattcatgcaggcctcagaaacctgcctgggcctgggccctgcccctctcttgtttcttttctggctggctgtcaccactgcagagctcaatctttcacagaactcatctaagtagcacaggaacctctcctgcctcaatctgactcacgaagaccttaggccagtgttgtgtgtgtgtgtgtgtgtgcgtgtgttagtcgctcagtcatgtccagctctttgcaaccccatggactgcagcccaccaggttcctatgcctgtgttagggagacgactcgccactttttgccagtcagcttggtggcacttaactcgggccatgagcgtgatcaggacgtatgggcagctatcttggtgagacaatgtagagggtgcgaggaaggccccttggctttccagggtgcctggaattcttctgttagagatgcatttatttagctctccaagtgttgtctacctctaagagcctcctgggcttcccatgtggctcagctggtaaagaatctgcctgcaatgcgggagacctgggtttgatccctgggttgggaagatcccctagagaagggaaaggctacccactccagtattttggcctggagaattccatggactgcgtagtccctggggtcacaaagagttggacgcgactgagtgactttttcactttttttttcaagagtctcctagtgaaataccaccactatatggactctgtgggagagggagagggtgggaagatttgggagaatggcattgaagcatgtataatatcatgtatgaaacgagtcgccagtccaggttcaatgcacgatacgggatgcttggggctggtgcactgggacgacccagagggatggtatggggagggaggagggaggagggttgaggatggggaacacatgtatacctgtggcggattcatttcgatatttggcaaaagtaacacaatattgtaaagtttaaaaataaaataaaatttaaaaaaaaaaaaaagaagaaaaaaaaaaagtaaagtcaactgattagtcaccttaaaaaaataaaaaaaagaggaggaatcattccttaggccacatgagaacgaataacaagagctggtgcttactcagcgttgcttcatcctcaccgcattcacaggagggaggtgctgctatcactcccgttttacagatgcagggtccaaggcacagagaggtttagtaactggtcccaaaccacacggggaaaaagtgaaggggccgggactgaacctgggcagtccacatggacactgcggcataatggcccctcccttcttcctcttggggacaaagttgggtctctctccgatggtgacaactcaggaagggaagtgagcacctcacagctagctttggttggggaggaattgaggacaaggcagaatccaggacgtgagtgaggtgtcagggacctcgcctgtgaatgtcaaggtcttctcgagatggcttggggatccctggaagaggacaggcccctctggccctgggtgggctgggggtgtgaagtggcaccccagggtcacacggttggatggacacaggacagcaggagggtgaggcggacatgctcagtggagcctgcttcttgaccattgagttctggctctgctatgtttcaaaagggaggccctagaaagtaaagtttatcctccttgggactcagtttcctcacctgtgaaatgggaataagtatggcaacagtacatactccatgggttgctgggaggacagaataactgcgggatgacctgcctgaggtgggtattcagtggagctcattgggcctgtagggcaggcggagcagattggtggagggagtctctgatggatgtgggaagatgctggggaggggctgattagactggggggaaattggggaagcctttgaggagatggagacaggctgggcaggctgacacatttggggtaaaggaagttgtggatcacagaggaaaaggaggtgacatgtctagtaagctgatgattgacctctgggtacctctggactttctggagttttgctgtgattctgtaatctccccacaaggccaggggtctcagccaggggtggtctctcgctctcctgcaggtagtctctccttcttcagcctccctccgcagggtgggagtctgccctggggtctatctttaggcttgagagtgagactttcatttgatggagcagttagatgataatcagacttcagatgttccagagtgagcaagtggttgtgagatgtgatggtgggtgaagaccgtgtgatgaggaatcttggtgaagaagatgtggtacagaatggcaatggaatattatttggccatgaaaaagaaggaaattctgccatttgaggcaacatagatggacactgagggcattctgctgagtgagataactaagagagagaaagacaaatactctatgagctcccttatatgtgaaatctaaaaaatccaaaatcctgaaaacagagagtagaatggtggtgaccaggggttggggtcaaggaattgatgggggaaatgttatttaagggtataaacttgcaaccagtagttaaataagtcctagaggtctaatgcagagcgtagagataggagtcaacaatactgtgttataaagttcacagttgctgagagtctagatctcaattgttctcatgacaaaaaacaaatgctaaattatgtgatgagatacagatgtgaactaatgctaccatggtcatcataatacagaagtgtatcaaatcaatatattgtgcccttacacaatgttacatgtcacttatatctcaataacatttttaaaatttcatttcatttaattaaaagaatgaattttggccatgagagatggtcagctagggaagagcatgagctctggagaagatggttttgtaatgtcaggaaggagacggtggggaaggagctgagaaaggtgtatgaggaaggtcctctaaggtgagggcaggcgatgagtgagagtttagtcaaagttgttggccctggggagggtggatgggctgctttcctgaggccaggtggaaggaaagggtgaccaacgtggagtgaagtaattatcaagaacagagagtggtccttaaaaaaataaaaacagaactaccatatgacccagcaatcctgctatggggcatatacccaaagaaaaccatgatcaaaaagacacatgcaccccaatgttcatagcaatgctgtatacagtagtcaggatgcggaagcaacctgaatacccatcaacagaggaataaagaagatgtggcacacatatgcagtgggaatactactcagccataaaagaacaaaactgggtcatttgtagatatgtggatggacctggagattgtcatatagcgtgaagtaagtcagaaaaagaaaacaaatatcatggattaacacaatatgtccatccagtctaggaaaaaatggtttagatgatcttttctgcaaagttgaagtagagacatagatgtagagaacaaatatatggataccaatgggaaaaggatgggctgggatgaattgggagattgggattgacatatagacactattgataatgtgcataaaatagataactaatgaggacctactgtatagcacaaggaaccctattcagtgctctggtgacctacagaggaaggaaatccaaagaagaaggggtgtatgtgtatgtacagctgatttactttgctgtacagtagaaactaatgcaccactctaaagcaactatactccaacagcaattaattttgaaataatagaaacaaataataataaaaagaacattgctgtgtgacacagggagctcagcccagtgctctgtgacaacctagaggggcggggtgggtggggggtgggtggggggttcaggagggaggggacatgtgtatacctgtggctgattcatgctgatgtatgccaggaatcaacacaaggttgtaaagcaattatcctccaaaaaaatttaaaaaaaggagaaacagagaagtaattggtgtaaatgaagacaagtcacttttcatgacctgaaaatcctgggaaagttatcagccagggatgagagagtatattaaaagttgaaaaaaataattaaacataaaactgtacatttatctctggtgtcatggtttcccaagtgcttattgtacatcatctcatttaaatagagaggagaagtctgaaatagatgccgagttgagccaactttgcacggcatgaatgtttacagaaagttatgtccaaaaggagtaattcaggcagaggaagcggagccctcagaaactaagagctaagagagtcctttcattcagagacacgaaggcagagacctgtggccagaatccgagccagcactggctggagaacttttagggagattgtaattaatcagattggaggtttaaattcagaagtggtcaaagtccagtattttcaacgactagcaaagtaaatgtacatcaatggccaggactgttggtgaaggatggaacccatcattatatgtggtcacagtgtccccggaaaccctactccacagaaaaggctcagtgtgcatgtcacatggcatagaattgagagaagacagaatcaccgatctttttaaaaaatgatctctttagtggaaagaaaacagattatacaagaacaaaatcatgccgggccaatctattagaatttgacatgaagatgagtagtcttctgaatgtaacttatatagaatttctacacagctttgtcttgtcagtggatactatgtgatatggactttctgtgaaataggtaaggatgtaaagttatgaaaaggggtcagtttaaggagtgaatgtaccctctggagtcaggcagcctggtggcccagagaaagtgacatttccaagggttgccaaaaacactaaattctttggtgccaaatcatcagaccaatggatagagactctagctatgtttaatagggattctaatatgtttaataagcaacacatggggcttcccaggtggcatagtggtaaagaatccgcctgccaatgcaggagacgcccggttcaatccctgggttgggaagatcacctggagaaggaaatggcaacccactacagtattcttgcttggaaaattccatggacaggggcctggcaggctacagtccatggggtcgcacagagttgaacacgactgagcactcatgcacgcaaaagcaaaacatacacattgattggtctctcttaatagtaatgacaatcctaacattcacaagaatttagtaagtatctgctctacttcagaccctgctccaggtgccttgtcatctgtaatcctaaccctcccaagagctctgcaaggcagaaacaagtattcctaatttacagatgagcagcaaaagcttggagagggctcctggatttctgttctttctccagtgtattaaattgctagaataccacagtctgggtggcttagacatcagacatttattttctcatagctctggaggctggaagttcatgatcaagatgtcaacctgtttgttttcccctgaggcttctctccttggcttgtagacttccgtctttctgtggtgccctcaaatggtctttcctctctgtctgtatcctaatctcttcttataaggacaccaatcagatagagttagtcgttgtgttgttcagtagctaagttgtgtccgactctttgtgaccccatggactgcagcaggcttcctgggccttcactatctcttggaatgtgttaaaactcatgtccattgagttggtgataccatccaaccctctcatcctctgtcatccccttctcctcctgcccccaatccctcccagcatcagagtcttttccaatgagtcaactcttctcatgaggtggccaaagtactggagtttcagctttagcatcattccttccaaagaaatcccagggctgatctccttcagaatggactggttggatctccttgcagtccaagggactctcaagagtcttctccaacaccacagttcaaaagcatcaattcttcagtgctcaggtttctttatggtccaactctcacatccatacctgactactggaaaaaccatagctttgactagacagacatttgtccgcaaagtagtctctgcttttaacttgactcttctttgaaggcccacctctgaggacagttacatacacaggtgctgggggttcaggcctcaacatgtgaatctgggggtacatgcagttcagcccacagctaacagctagtagagtaacataagggaaaaccggggtaagctggtcatggagcctcgtaagcacccctctcagaagctgggaaggtgtgctttcttcccttgggggttggggagggtgggaacagtaaatgaaccccacagtaaacttccagaatttgctaggaggtgaaagcctctctctccccctcctttccacacacccgcccttccatccccaaatgaagtctttcctctaggtcagaagtgctgagtcacgctgctcctttccttcaccccagggtcaaaaacacagagttacaaggagagacgcggcctcccgcaccccagctcagggcccagtcagagctgctggagagaggcccacagaacagaactgaggtggggtgtgcggaatggggccgactccagagccgcccaaggcacagaaaacctctctgcattcaatttgtagcaaagtaaacaattcgcagcaagtaaacagggcgcctattgtgtccagcgttctgtggactgggcttcaaagaggacttttgttctaaaggatattttaaacttcttcattagctaggaaagctattttaaaaactatttcccagacacccaaatacctatcataaaaagaagaagaaaaaaatcacaacacttatgaataagcaggaatggtcatgtgtagccctggcttcaaggctgatcaaggtggcttccctggtggcccagggggtaaagcatctgcctacaatgtgggagacctaggtttgatctctgggttgggaagatctggagaaggaaatggcaacccactccgatattcttgcctggaaaatcccatggatggagaagcctggtaggctacagtccatggggtcacaaagagtcagacatgactgagcgacttcactttgcttcactttgctgtctactcctgagtgaggcttggagacagatgcaggtgaggaggataagtctcttgccttgagggctaagcgggtgacgaggatgagccttggaaactggctgtgaaggacaacaccactctctcccccgcacacagctctgcttgggaggaagctgaaaggggagagggactagctacacaactccagggggcgccctccacctcggcaaagctcagctatttgtctcgactcctgtggagaaggaaatggcaacccactccagatttcttacctagagaatcccatggactgaggagtctggtgggctacatacagtccaaaagtggcaaagagtctgacacgactgagcgaccacgtatgctgtgtgagaggaacccctctgggggagttaaactgaggaggtgggaaacagggctgaggagccaaggaacgcctcaaggagttaggaccggaaagaaaggggtgggaggggtctgggtagtccctgtctaggggcttccctagggacacaggagaagccccagcacgtgtcctaccaaatcctcattatggcaccaaaatgctcccccaggcatgctgagagccggcagcttatgtcctgtcctgaaggcccagcagacaccctggcggccttcctggaggctgcggcaggttgctccatggagggggtgccacatctctcaggctctaagaagcaggctacccgtgggatcactgctgctgctgctgctaagtcgcttcagttgtgtccaactgtgtgaccccatagacggcagcccaccaggctctgccgtccctgggattctccaggcaagaacactggaatgggttgccgtttcctcttccaatgcatgaaagtgaaaagtgaaactaaagttgttcaatcttgcccacagctctcaggctctaagaagcaggctacccgtgggatcactgctgctgctgctgctaagtcgcttcagtcgtgtccaactgtgcgaccccatggactgcagcctaccaggctcctccatccatgggattttccaggcaagagtactggagtggggtgccattgcctttcttcataaacatacccagctccttctcaggggctcccgagaacctccggcagaactgccacccagggctggccacgagggaagccacatcagagtcccctacatggtacctacctctcttcaccctcggggaggaacttgaggcccaacaaaggaagctgacacagaaggcatccgggaagagaagctggagaggccactgtgatgcttgccttctcctgctctggctcattcttcagtttcctcaatgagagctgtaacctttggatgttgtttagtcactcagttgtgtcctactctttgagaccccatggactgtagcccaccaggctcctctgtcaatgggatttcccaggcaagaatactggagtgggttgccatttccttctccaggggatcttcctcacccagagatcgaacccaggtcttctgagttggcaggaggattctttgccactgagccacctgggagcccctgcaaccctttgtctgatggcatttactctcattgtaatgtcaatacactgatagttgacctgtgatcaggataaggacagttccatcagatcctttcctaggagcagattggggtggggaaggaggggagaccctaagccattcttggtggtggtggtggtggtgatggtgatggagagggggttgtggaccagcaggaaggtgggcaagaagcaggaagaaggcagagaggagcccgaaacaagtctgcccactacacaatattgcctccatctggcctggcttggacagactgaatgattgtgatattatccagaatactaggccgctgaccaaagacgtctccagatgctcagaagttgtacttccaagcataattcttggctgtcccagaaccacaagtaattgatgatgcgccctccccacccgccccctttccacatcttattctttccagctcctggacagatacattttcttgtttgcagactcattcattccaggttttgcagcaatctcagacttgaaaaatgcaagtgcagtgtggtcgcgttcatctgtggtcacctggtcctcattaaggccattggaggcagccaggacctggttttgtgattagtggttctcctccatgtaggcttgagagctctcagtgggctctcgttgtttgcatgaagtcctcggaggacaatgccaggctcaactccacgttttccacatgaccgatggcattcgaagctttgcaatcccaataggcacatttcttgactggctttgtttctcatgggttcaggtggaataaaaaggttttctgctgccaagaatgtcagtgtgtggttgggaagttggcatttttctctagaaggaagggaagtcagttggtaagtgacggatgtctcatgccaacagtgagaaaggttgtttcagtatttctcagttttagtgaaactagagtctgccatcacgggtaaggaggggccaggagtcttcctggggggcttgtgaacgtctcccgctagcagcaggctgttgttaagccctgctgtgtacattctcctgaggccgcctggaggctggggctgggattggggtggggtggggggtgctctgggattcgtctttcatttctgcagctgggaagatggctcggcctctgccaaggccttttgtcccatttttctcttgcttcattgggacatttccggaaccaaatatattcaactaatcctcagcttcaggaggtgattgaatatccaaatgctggcccttccattgtccgatgactaggaccagctgaaacactcaattttgcaaaacagtcacgctccagccattggcccaattatctcttccaattacaatgtcttcccatcctcttctcatggaagtgtttgaggcccctatggattctgggaattctcaggctgaattccacccttcatgcaccagagacacgaggcaaagtcgcctgctccatgggtgtttggttctactgtactttgacatggattccaaagtctgtgtcttactgaagacaggctattgttgtctttattattttgaaatggacacactgctgagagcctggatctgagcctgaagataaatacgggtactcagaggccttgaaatccatccttgcagcttgctaatccttgcaggccttttagaacagagccagactaaacagagagctgccactccctccccagggccaacactttggggcttttgtcaactgggcaggagtgcaaatccttgaagataccctccatagaaagcctgtttctttatgttctttgggtcggaccttagccaatgttggcaacgtggccttgcgtggccctggggaacctcgacatttcttcatttgagtgtccggggtctagactccaactcgactgcctgtctcagggagcaggaatgaggtgttgtcagcctctgagattgagaggaagctttggaattaggaagagtccggtttctgacaagacagtggaatgggagtcagggaggaaggctttggagcgacaagatgggtagggaaggtggtgaacaggcaggcagtccgtgttgatcatcctgtgctaacggcgcatctggtgtctctcagagtcactgagagcttggggaactgtatcctttcactcagccaggtgcctcccagacacgcaagtgccaggtaccacctgcccctcagacatacaagggccaggtaacccccccaagattttatgcaagggccaggaagccccccaagcatgaaagtaccaggtaccctccccctgacatgcaactgcattagctctgcagctatatatgatgcttcacccaatgtggcgacctccagccccaccgagaaccactcacaggctgtcccctggcagaacctggcactgcagggtggtccacagttcctcctgtaggggttgtctctccatcttccccaccacttctcctgcagtgtgtgtattagacgcccagacctgtccgactgtttgtgaccccacggactgcagccctccaggctcctctgtctgtgggattccccaggcaagaatactggagtgggttgctatttcctcctccagggaatcttctcaacccagggatagattcctgctgcactgcaggcagattctttaccgtctgagccacgtcaaagctttctgtatccccatcgctctccccttatccaaaagacaccagtgaagaaggggaaaaatcctcctgtttgggagagcaccctcttttagttctttctttgggtcctaacctccagcagtcccttgccccagctgggtgacactgtttcaagacagcccactttggggacctgatttcactgtctttggaaagccaccctgaaaggagagtccaagttcaaattcagttcctaagaataagggaatccacacatccactgtgactgggatgataggggggacttaggtggaggttgggggcaaggatcagggaagggaaccaggtggggtgggggcggggtggcaagtcagccatcttgtctcaggagaacctcagctgagtcacagaagtgcctctgtggctgtcgtggaaacctctggactacacagtaagccccctacatatgaatgagttccattctgagagcacatctgtaagtccaatttgtttttaaatcccaacaacgtcggtccaggtacccaactaaaatatttgactatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatgcaaatatgagctcgataaaggacagaaatggtatggaccttaacagaagcagaagatattaagaagagatggcaagaatacacagaagaactgtacaaaaaagatcttcatgacccagataatcacaatggtgtgatcagtcacctagagccagacatcctggaatgtgaagtcaagtgggccttagaaagcatcactatgaacaaagctagtggaggtgatggaattccagttgaactattccaaatcctgacagatgatactgtgaaagtgttgcactcaatatgccagcaaattcggaaaactcagcagtggccacaggattggaaaaggtcagttttcatcccaatcccaaagaaaggcaatgccaaagaatgctcaaactatcgcacaattgcactcatctcacatgctagtaaagtaatgctcaaaattctcaaagccaggcttcagcaatacatgaaccatgaacttccagatggtcaagctggttttagaaaaggcagaagaaccagagatcaaatggccaacatccgctggatcatcgaaaaagcaagagagttccagaaaaacatctatttctgctttattgactatgccaaagcctttgactgtgtggatcacaataaactgtggaaaattctgaaagagatgggaatatcagaccacctgatctgcctcttgagaaacttgtatgcaggtcaggaagcaacagttagaactggacatgcaacaacagactggttccaaataggaaaggagttcgtcaaggctgtatattgtcaccctgtttatttaacttatatgcagagtacatcatgagaaacgctggactggaagaaacacaaactggaatcaagattgccgggagaaatatcaataacctcagatatgcagatgacaccacccttatggcagaaagtgaagaggaactaaaagcctcttgatgaaagtgaaagtggagagtgaaaaagttggcttaaagctcaacattcagaaaacgaagatcatggcatctggtcccatcacttcatgggaaatagatggggaaacagtggtaacagtgtcagactttatttttgggggctccaaaatcactgcagatggtgactgcagcatgaaattaaaagacatttactccttggaaggaaagttatgaccaacctagatagcatattcaaaagcagaaacagtgttttgccaacaaaggttcatctagtcaaagctatggtttttccagtgatcatgtatggatgtgagagttggactgtgaagaaggctgagcgccaaagaattgatgcttttgaactgtggtgttggagaagactcttgagagtcccttggactgcaaggagatccaaccagtccattctgaaggagatcagccctgggatttctttggaaggaatgatgctaaagctgaaactccaatactttggccaccttgtgcgaagagttgactcattggaaaagactctgatgctgggagggattgggggcaagaggagaaggggacaacagaggatgagatggctggatggcatcactgactcgatggacgtgagtctgagtgaactccgggagttggtgatggacagggaggcctggcatgctgcgattcatggggtcgcaaagagtcagacacgactgatcaactgatctgatctgatctgaaccagatggccttagcacatggcacaaacatggtccactggagaagggaatggcaaaccacttcagtattcttgccttgagaaccccatgaacagtatgaaaaggcaaaaagataggacactgaatgatgaactctccaggtcggtaggtgccctatatgctactggagatcagtggagcaataattccagaaagaatgaagagatgacgccaaagcaaaaacaacacccagttgtggatgtgactggtgatggaagtaaagtccgatgctgtaaagaggaatattgcatgggaacctggaatgttaggtccatgaatcaaggtaaattgaaattggtcaaacaggagatggccagagtgaacgtcaacattttaggaatcagtgaaataaaatggactggaatgggtgaatttaactcagatgaccattatatctactactgtgggcaagaatcccttagaagaaatggagtagccatcacagtcaacaaaagaatcctaaatgcagtacttggatgcaatctcaaaaatgacagaatgatctctattaatttccaaggcaaaccattcaatatcacagtaatccaagtctatggatttggtggctcagatggtaaagcatctgcctacaatgcaggagacccgggttcaatccctgggtcaggaagatctcctggagaaggaaatggcaagccagtccagtattcttgcctggaaaatcccatggacaaaggagtctggtaggctatagtccatggagtcacagagttggacatgactgagtgacttcactttaacccaagtctattccccgacccgtaatgctgaagaatctgaagttgaatggttctatgaagacctacaagaccttatagaactaacacccaaaaatgatgtcctttttattataggggactggaatgcagaagtagcaagtcaagaaatacctggagtaacaggcaaatttggccttggagtacagaatgaagcagagcaaaagctaatagagttttgccaagagaacacactggtcatagcaaacacactcaaagattctaccgctgcacatgaccaggtggtcaatacagaaatctgattgattatattctttgcagccaaagatggagaagttctatacagtcagcaaaaacaagactaggagctgactatggctcagatgatgaactccttattgccaaattcagacttaaattgaagaaagtagggaaaaccactagaccatacaggtatgacctaaatcaaatcccttatgattatacagtggaggtgacagagtattagagctgatagacagagtgcctaatgaaccatggatggaggttcgtgacactgtacaggaggcagggatcaagaccatcctcaagannnnnnnnnnnnnnnnnnnnnnnnnnnnnnnnnnnnnnnnnnnnnnnnnnatcaatataacctcattacagataaattgggaaatagtttttttaaaaaaatgcccgtaatcccacaatcaaacccagccactgttgacattttagagtttcctttctagacttcttgtgcatttttatttacataattttaatcacactacacacatcattttgtgttctctttccttccttaatatcttaccagcaacattttcagattttttaattatctttgtgactattataaaaactgttgcattaggaacttccctggtggccagtggctaagacttcacacttccaatgcagggggcctgggtgtgatccctggacagggaacttgattccacatactgcaactaagaccctccagagccaaataaataaatatttttttacacctatgtgttatattccatccgaggaaatgccattgtcctcttaatcattcccctgcttttggccattttgcttcaccatttttcatgcttcattcttttttttttttttaattggaagctaattactttgcaatattgtattggtttttgccatacattgacatgaatcagccacgggtgtacatgtgttccccatcctgaaccccctcccacttcccatccattccacccctcagggtcatcccagtgcaccagccctgagtgacctgcctcatgcatcgaactaggactagccatctatttcacatatggtaatatacatgttgatgaaagtgaaagtggagagtgaaaaagttggcttaaagctcaacattcagaaaatgaagatcatggcatccagtcccattacttcatgggaaatagatggggaaacagtggaaacagtgtcagactttatttttttgggctccagaatcactacagatggtgactgcagccatgaaattaaaagacacttactccttggaaggaaagttatgaccaacctagatagcatattcaaaagcagagacattactttgtcaacaaaggtccatctagtcaaggctatggtttttccagtagtcatgtatggatgtgagagttggactgtgaagaaggctgagcaccaaagaattgatgcttttgaactgtggtgttggagaagactcttgagagtcccttggactgcaaggagatccaaccagtccattctgaaggagatcagccctgggatttctttggaaggaatggtgctaaagctgaaactccagtactttggccacctcatgcgaggagttgactcattggaaaagactctgatgctgggagggactgggggcaagagaagaagaggacgacagaggatgagatgtctgaatggcatcactgactcaatggacgtgagtctcagtgaactccgggagttggtgatagacagggaggcctggcgtgctgcgattcatggggtcgcaaagagtcggacacgactaagcgactgatctgatctgatctgaatatacatgtatcagtgctattttcatgcttcattcttaaaaccaatctgaagatgaacatctttgggcatcggtttttttctgcatttaggaaggcctccttcactcagcatcccaaggaaaaatttcctgaactatttatggtcttaaggtcacacagttttcccaaagagggcacagcaggctggagcagccctcagaagataggcagaactggggggaaaataaggcccacatagcaagcatcctaagttctcagtctccaagaaactacaaccaaacttccccagaactagggaaagaggtcagaggacccaggaagaggaactgggaatggctgaaaacacctgatttatgtggagatctgtgccagagaatgtgagtaatgagtctagacgtggtaattgcccacgtgtgcagacggtgcacttggacctgcaccgccctgaattgctcaagtgctctgctgcagaggctgggcgtgggagaaggatgggtgaaggccatgatcccaggggcatgacacttagagaagctctactgtcctgggagatggcatccaaagttataaaaagacagaaaccgccccaacccaatggttcctggaagtcaccccacctagcacctcacccagcgtgaaaagtattagtcactccgtcgcgtctgacactttgcaaccccatggtctgtagccctgccaggctcctctgtccatgggatttcccaggcaagaatactggagtgggttgctgttctcttctccaggggatctttccaacccagggatcaaacctggatttcctgcattgcaggcagattcttaaccgtctgagccaccagggaagccctgacctcacccagggcatcatgtaaagagggagcccctgcttgtgccaggctgcttgccttggtccgttccttcatgccacactccatcctggattttatcctttcaactttcattcttattggtcattcttgcatgcttcaacggtgttcataggcaaaatccttttgctttggactttggttccttcaaatcgtagttcaccatccaacatctctgagcccatcatgggcacctctctgcttcgtcctttcacatgcctccaggacctctgcagtacccaccctggagggccccttccctgggttgtctcctcactcacaggctccatgcactacctcaacactgctggcacctagagagatcttccagcccagatctctctcttgggctccaggcccacattttggctgactattgacatctctaccaggatgttccaaagcgactcagattcaagactccagctgaatccagtaactcctctttgggtcctgtgtcttgtgcgtgacactaacaaacatctagttcttaagccagaaatttgcaacccttctagccttgactctggagaggcgatggcaccccactccagtactgttgcctggaaaatcccatggatggaggagcctggtaggctgcagtccatggggtcgctaagagtcagatatgactgaatgacttcactttcacttttcactttcatgcattggaggaggaaatggcaacccactccagtgttcttgcctgaagaatcccagggacaggggagcctggtgggctgctgtctatggggtcacacagagtcggacacgactgaagtgacttagcggcagcagcggcagccttaaccctatttcttacttcccatcatttaatcagttgccaagtaacactcaaatccatctcatctttctgatctacctcactccagggtccttaaattcactcctgatcacccctcactgacttgagtcttcttctgcttccagagtggtctatttcaaatggcattctgagcaggtccccccctactgacactctcactggctcctggatactctggagtaacattccaaatccattcactcattcaaaaaatatttaccgaggtcttaccatctgacaggcactgtgccagcagtgggtatacattgataaatagagaagacatggtgatataaaattcagtgaaatccaaagtcatctgtgaatggctcttccacatatccagcttaacctctcagtgcatccctgccttgcaccagacggttcccccaaagtaccacttccttgcttttagtaagttggtgccctttacaagcttccccacatattttggatgattattatggtcctcctaactcagctgcattctcagctcctcttgaaagctttccctcacaccccactataatcctgttcatattcacctgcccttcctctatgccaccagcatctgtgtttaactctacagttgcacttactacacagtgtagtattctctttcccacccacaccctatacacacacatacacatactcagaagctccttaagtaatggttatttttttcacccatacccaacaatgtgtggtacatagtcagcatttggtaaatgaactagatagataacagacttcattcttattattgaattaatatcatatttaatgtatggtgactcttgaacaacccaaagttgaactgtgggagtctacttatacacagatttttttttttcattaaatatactacatatttgggggagattggcaacagtttgaaaaaactcacaaactgtgtagccagccaagaaagatcttaaaaattaagaaaaagttaggtatgtcatgaatgcataaaatatatgtaggtatacatacaacatacaatatatgtattaactgacaattattttatcagcaatgcctctggtcaatgaggctgctagtagttaagttgagggggagtcaaaaattatacacagatttttcgaatgttgcagggcatcagtgtccctaaccccaatgttattcaaagggtaactcttttatttacataattcattataaatgcaagcaactatattaatcactttggatgtaacgtaataagctccagagggactagcattaagctcacctgttcagtgcttagtgaacagttttcttgactgcccaccgtatgtcaggcatcattcttgcacttgggatactgcaaagttagcaagtccctctcctattgaagcttgtatttgtataaatgtataaatatgtataaatatgtgctgttgttcttgtttagtcactaagttgtgtctgactcttttgggaccccataaactgtagccctccaggctcctccatccacgggattttccaggcaagaatactagagtgggttgccatgctctcctccaggggatcttaccaacacaggatagaatccacatctcttatgtctcctgcattgaaggtgggttctttaccacctgtaccacccggaaagcccctataaaaacattttgttgttcacttatgcagtcgtgtctgactcttgtgaccccatggacttcagcacaccaagcttccctgtccatcatcatctcccggagcttgctcaaattcatgttcattgagttggtgatgccatccaaccatctcatcctctgtcgtccccttctcctcttgccttctctctttcccagaattaaagtcttttccaatgattcagttctttgcatcaggtggccaaatgattggagtttcaactttagcaacagtccttccaatgaatactcaggactgatttcctttaggatggactggttggatctccttgcagtccaagggactctcaagagtcttttccgacaccacagttcaaaagcatcaattctttggcgctcagccttctttatggtccagttctcacatctctatggacatttgttggcaaagtgatgtctgctttttaatacactgtctaggcttatcatagcttttctttaatgccatgaagaaaatctcaaaataatgggagagagcactgaaggaggcaatgaagaggcactcataattagctaaaggattcatgaagactggactggaaaaggtcagttttcattccagtcccgaagaaaggcattgccaaagaatactcaaagtaccgcacaattgcactcatctcacacactagcaaagtaatgctcaaaattctccaagccaggcttcaacagtacgtgaaccgtgaacttcctgatgttcaagcaggatttagaaaaggcagagggaccagagatcaaattgccaacatctgttggatcaatgaaaaagcaagagaattccagaaaaacatttacttctgttttatcgactaggccaaagcctttgattgtgtggatcaaaacaaactgtggataattcttcaagagatgggaataccagaccacttgacctacctcttgagaaatctgtatgcaggtcaggaagtaacagttagaaccaggcatgggacaacagactggttccctaatagggaaaggagtatattgtcaccctgcttatttaacttatatgcagagtacatcatgagaaatgctggactggatgaagtacaagttggaatcaggattactgggaggaatatcaataacctcagatatgcagatgacaccacccttaaggcagaaagtgaagaagaactaaagaggctcatgatgaaagtgaaagaggagagtgaaaaagttggcttaaaacccacaactcaggaaactaagatcatggcacctggtcccatcacttcatgggaaatagatggggaaacagtggcagactttattttgtgggctccaaaatcactgcagatggtgactgcagccatgaaattaaaagatgcttgctctttggacaaaaagttatgatcaacctagacaacatattaaaaagcagagattctactttgccaacaaaggtccgtctagtcaaagctatggtttttccagtagtcatgtatggatgtgagagttggactataaagaaagctgagtgctgaagaattgatgcttttgaactgtggtattgatgaagactcttgagagtcccttggactgcaaggagatccaaccagtccttcctaaaggaaatcagtcctgaatattcattggaaggactgatgctgaagttgaaactccagtactttggccacctgatgcgaggaactgactcatttgaaaagtctgtgatgctgggaatgattgaaggcaggaggagaaggggacgacagagggtgagatggttggatggcatcaccgactcgatgaacaagagtttgaataaactctgggagttggtgatggacagggagacctggtgtgctgcagcccatgaggtctcaaagagtcagacacaactgagcaactgaactgaactctttatctcaacttcctcatctgtaaggtgggagtcttaaaaacagctccaatgtcagggtgcttgaaggactgaatgagaaaatatggacgcagcagtgacatttcataaaagtcaccttattgcagggtttgaagccagggagagaggtaatctaatttttgctctgacaggaatacccaactgcagatgggaaattgtttgcatgaccaggaggggcatcatggagaccacacaggggctattgtgatggcaaggtgaagttgctgacttcaggtctctggaagctgctctcgttaggtatccctgtgctttactgacacatcccactacaaaggcaagttaagaagatttcctgctgggtacgacaagcatgtctgtgccttatgggatgtgtgagaacaagcctgggtttccagcagctcctgggaatcacacacttgtccagtgtcaagctctgtgtggatcacacctaggcagacattcacatctggctgtccagtgtgcttgtgtctctgctgttcctttcctgtctccttggagtttcagatccgtaacatttgaacatttcccctagagtttcccagagttctagaagctcctttgccatcactgcacttttaagacttttaaagctttgatgaactgaatgaaggagaacatgtgcaattttagattggctaactaaacactcagaaacacacacatttcttataaacatgatctatctgtcatctgttaatggtgaagtttttgaatgtcatcagggtgccatgctatgattaaatacttgcccattcagtggttggactgaaacatgaaaattacaaacacatttacttcaggaaacacaagcttgttgaatgaatgaatgaactaattcttgactaatggcacccccaagagtggaagtaagaaagaagctactactacttctgcttctctacttctgcttcattgactatgctgaagcctttgtgtggatcacaacaaactgtgtgaaattcaccaagagataggaataccagacataccttacctgcctcctgagaaacctgtgtgcaggtcaagaagcaacagttagaattggacatggaacaacagactggttccaaatagaaaaaggagtacgtcaaggctgtatattgtcaccctgcttatttaacttatatgcagagtacatcatgagaaacactgggctggaaaagcacaagctggaatcaagattgccaggagaaatatcaataacctcagatatacagatgacaaaatagaagaagaactaaagagcctcttgataaaagtgaaagaggagagtgaaaaagttggcttaaagctcaacattcagaaaactaagatcatggcatccagtcccatcacttcaaggtaaatatatggggaaaaagtggaaacagaggcagatttttttttcttggactctaaaatcactgcagcgactgcagtcacaaaattaaaagatgcttgctccttggaaggaaagctatgacaaacctagacagtgtattaaaaagtagagacactactctggcaacaaaggtccatctagtcaatggtatggtttttccagtagtcatgtatgggtgtgagagtcggaccttaaagaaggctgactgataaagaactgatgcttttgaactgtggtgttggagaagactcttgagagtcccttggactgcaaggaggtccaaccagtcaatcctaaaggaaatcagtcctgagtggaaggactgatgctgaagctgaagccccaatcctttggtcatcttatgtgaataactgactcattagaaaagaccctgatgctgggaaagattgaaggcaggaggacaaggggacaacagaggatgagatggttggatagcatcacggactcgatggacatgagcttgaacaagctctgagagttggtgatggacagggaggcctggcatgctgcggttcatggggttacatggagtcggacatgactgtgagactgaactgaactgaactgaagaaagaagcaactagtgaagctgctctaaactatctccactttaatcttgtgtgacttggtccaaatttctgggcttggtccttccttcctccctccctcccttccacctttgtttaattttagttgtgcaagtgatacatacagcatccacacaccaacaaggactcaggcctctccctagaagtcaccactgtttttagatttatataaatacttctgaaattatttctatgtactatagaagtatatgtagttggatatgtatgtatgtactacaaaagtgcatgtatgaatgtacatacaaaaatatataataatgttttgttttgatataaatgtatcacattgtgtgcatcattatgaaatttgcttagttttctcaaggttaacagtatgtcttcaaaagctctccaatgtcagtatgtataattctacttcattttgttaaactgaggctcagcatcactagacactgtaatttacatgtatcttaacatatttaataattcttttttctttttgtaattgtgtgtgtgtgtatgagagagagaacccaagtacagaaaacgaaaaaaaaaacaacaacatatggcttaattgtttaagtgaacatctctttagttcaaaacagaatattaccagccgcctagaagtctcctcaataccccaatcatcatacctgtttgataagagtagccattatcctggcttttatggaagtcacttcctgaattttaaaaagtttttaacctcctaagcttatatccctaaacattatagtttagtttcacttgatttttgaatttcatataaatggaaatttgtagtatgccttcctttgcatttggtttctttgtttatgacagtaatccgtgttgttacatacagctgaagttcattcattttcattgctcactttattttgtgaatatgttctcattcagttatgcaccccactgttataggactttttgactgtttacagtttgaggttcctgggaactttttcctggacattcttgtgcatacacatgtgcatgtatttctattgggcatagatatagggatggaactgtaggaatataatgtgtgtgtactttcaaattcagaagtaatgctaacctgtttttcaaagtggttgcatttattcttttattagcaatgtatgagagttccctttgctttattacttcgccaacacttagtattatcagtctttctaatcgtagccattttgatgaatctgttgattctcactgtggttttaatgtgcacctttttgatttagaggtacattggccatttggattaatgtcttttgcccattcaaattgtttgcctctcagttatctttttctcatgtgcacatgtgctcagttgctaaaactctttgtgaccccatggaatatagcctgccaggctcctctgtccatggaattctccaggagagactactggagtgggtaaccattcccttctccaggggatcttccagatgcaaggatcgaacccagatctcttgcattgcaggcaaattctttaccatctgagccaccagggaagccttttcttattggtttataaaagttgcttttaagaaaaatcttgaatggttgcttgccctttctctatgttaatggtatctttggttgaacaaaaattcttaattttaataaagtacaattttttaatctttattttgatggttaatactttatgtgccctctttaggaaggttttttttctctctcaaagtaggaaaagagtatactctattatcaactaaaagtttggttttatctttcacatttagatctagaatacatctgaaattgaattttatgtatgatgtgagatatgggttgaacttttttctttccatgtagatactctttgtcctatatcatttgttggagagagctgtgttaaatacccaggctccaaatatgcatgagtgtgtttcaaggtctctttatattgtgccattgaaacacctgtctacccacccacgaatacacagtattttaattaatgtggtttcataacttgatatccagtagagcaaatccttctgccttattattcttcttaggaaagttttgcaattctctgtcctctgcatttcaatgccactagatctttttgacacatggtatgatattatttatgaataatgagatttttatattttcctttctaattcatctctctttcatttccctatcttgttttctctacattggctaggagccccagcataatgctgaataggagtaagagtggacatttgtgtcatattaacatcttcaaaaggaaaccttttaacatttcatccaataagtatgatgtttgctactgtggttttttttccttagataacttttaccaccttggggaagttctcgtccatttccaattttctaaaacaaaattttatggatgataaattttatcaaaagatttttttccaaatccctgaggtagtcataattgttttaatctcttaatgtagcaaattacactgattattttctaatgttattcacagaataagtttaatttagtcaagatatcattttttcataatgcgaaatttggttggccagtgtttgggtttttttttttttttagttttgtcaactttatttattttttaatataaatttatttattttaattggaggcaaattactttacaatattgtgttggttttgccatacatcaacatgaatccaccacgggtgtacacatggtccccatcctgaacacccctcccacctccctccttataccatccctctgggtcatcccagtgcaccagcccagagcatcctgtatcatgcatcaaacctggactggtgattcgtttcacatatgatattatacatgtttcaatgccattctcccaaatcatcccaccctctccctttcccacagagtccaaaagacttctatacatctgtgtctcttttgctgtctcacatacagggttatcgttaccatctttctaaattccatatatatgcattagtatactgtattggtgtttttctttctggcttacttcactctgtataataggctccagtttcatccacctcattagaactgattcaaatgtattctttttaatggctgagtaatactccattgtgtatatgtaccacagctttcttatccattcatctgctgatggacggctaagttgcttccatgtcctggctatcataaacagtgctgcgatgaacattggggtaaacgtgtctctttcaattctggtttccttggtgtgtatgcccagcagtgggattgctgggtcataaggcagttctgtttccagttttttaaggaacctccacactgttctccatagtggctgaactcgtttgcattcccaccaatagtgtaagagggttcccttttctccacaccctctccagcatttatagcttgtagacttttggatagcagccattctgactggcgtgaaatggtacctcattgtggttttgatttgcatttctctgataatgagtgaggttgagcatcttttcatgtgtttgttagccatctgtatgtcttctttggagaaatgtctgtttagttctttggcccattttttgattgggtcgtttatttttctggaattgaactgcaggagttgcttgtatatttttgagattagttgtttgtcagttgcttcatttgctattatttcctcccattcctctcatttcaccttacttatagtttcctttgttgtgcagaagcttttaattttgattaggtcccatttgtttatttttgcttttatttccaatattctgggaggtgggtcatagaggatctttctgtgatttatgtcggagattgttttgcctatgttctcctctaggagttttatagtttctggtcttacgtttagatctttaatccattttgagtttatttttgtgtatggtgttagaaagtgttctagtttcattcttttacaagtagttgaccagttttcccagcaccacttgttaaggagattgtcttttctccattgtatattcttgcctcctttgtcaaatataaggtgtccataggtgcgtggatttatctctgggctttctattttgttccattgatctatatttctgtccctgtgccagtaccatactgtcttgatgactgtggctctgtagtagagcctgaagtcaggcaggttgattcctctggttccattcttctttctcaagattgctttggctatttgaggttgtttgtatttccatacaaattgtgaaattatttgttctagctctgtgaaaaataccgttggtagcttgatagggattgcattgaatctatagattgctttgggtagtatactcattttcactatattgattcttctgatccatgaacatggtatatttctccatctattagtgtcctctttgatttctttcaccagtgttttgtagtttcccatatataggtctttagtttccttaggttgatatattcctaagtattttattcttttcgttgcaatggtgaatggaattgtttccttaatttctctttctattttctcattattagtgtataggaatgcaagggatttctctgtgttgattttatatcctgcatctttactatattcattgattagctctcgtaattttctggtggagtcttaagggttttctatgtagaggatcatgtcatctgcaaacagtgagagttttacttcttcttttccaatttggattccttttacttctttttctgctctgactgctgtggccaaaacttccaaaactatgttgaatagtagtggtgaaagtgggcacccttgtcttgttcctaactttaggggaaaggctttcaatttttcaccattgaggataatgtttgctatgggtttgtcatatatagcttttattatgttgaggtatgttccttctattcctgatttctggagagtttttatcataaatgggtgttgaattttgtcaaaggctttctctgcatctactgagataatcatatggcttttatttgtcaatttgttactgtggtgtataacactgattgatttgcagatattgaagaatccttgcaaccctgtgataaagcccacttggtcatggtgtatgatctttttaatgtgttgttggattctgattgctagaattttattaaagatttttgcatctatgttcatcagtgatattggcctgtagttttctttttttgtggcatctttgtcaggttttggtattagggtgatggtggcctcatagaatgagtttggaagtttaccttcctctgcaattttctggaagagtttgagtagaatacatgttagctcttctctaaattcttggtagaattcagctgtgaagctgtatggacctgggcttttgtttgctggaagatgtctgactacagtttcaatttctatgtttgtgataggtttgttaagattttctatttcttcctggttcagttttggaaagttgtacttttctaaaaatttgtccatttctttcaagttgtccattttattggcatataattgctgatagtagtctcttatgaggagaaggcaatggcactccactccagtactcttgcctggaaaatcccatggatggaggagcctggtgggctacagtccatggggtcactgagggtcagacataactgagcaacttcactttcacttttcactttcatgcattggagaaggaaatggcaacccactccagtgttcttgtctggagaatcccagggacaggggagtctggtgggctgccgtctatggggtcacacagagtcggacacaactgaagtgacttagcagtagcagcagtctcttatgaccttttgtatttctgtgttgtctgttgtgatctctccattttcatttctaattttattgatttgatttttttccttttgtttcttgatgagtctggctaatggtttgtcaattttatttatcctctcaaagaaccagcttttggctttgttgatttttgctatggtctcttttgtttcttttgcatttgtttctgccctaatttttaagatttctttccttctactaaccctgtagttcttcatttcttccttttctagttgctttaggtgtagagttaggttatttatttgacttttttcttatttcttgaggtatgcctgtattgctatgaacttagctctgcttttacaatgtcgtgtttgggatttttgcttgtggattctagagtataattgacttgaattttcctttctcataatgtccttgtcaagttttgacatcaaggttgtgttttactcatataacaagttttggagaattcctccttttctattttctaagaccatacatataagactggtgttatttcttcgccaaacatttgaattcaccactgaagatttcagggaacagattctgactttcaggactgtggaattatgtagtgactgtttgagttttctcaatttaatccacatgacatcatatctggacaatattattcagagtttatattatgttagtgaaagagtaattgcaattttggattatgaattttaaatcattgtaactaggctcaaacacatctttactagtcaaaataggatccattacaatgaacacatttttgccaatgagaaataattttgtttattcctgtaatgtaaaaaaagcatttttagcatcctgctaactgtggaagcacttttcttacaaaaagttgtagagatgcttgaagaagaggtagttggttggtgagagatcaggtgactatgacagatgaagcaaaacttcacagtctaatttgttcaacttttgaaactttggttgtgcaacatgctacggttgggtgtcattgtggagaagaattgggcccatttcgttgaccaatgccagctgcaggcattgcaattttcagtgcatttcatcaatttgcagagtgtacttaccagatgtaatggtttaaccaggattcagaaacttgtagtggatcagacaggcagcagaccaccagacagtgaccatgaccttttttgggcacaagtttggctttgggaagtgctttggagcttcttctcagtccagccaccgagctggtggttgccagttgtcatataaaatccacatttttgtcgcccgtcacaatctgagaaatggttcgttgtcgcacagaataagagaagacaacacttcaaaatgacatttttttaaatttccagtcagctcaccaggcacccacttattgaggtttttcacttttccaatttgccgcaaatgctgaatggccatggaatggtcaacgctgatctcttcaggagcatctcgtgtatttgtaagagaatcagctttgatgatggctctcagttgattgttgtcaacttctgatggctggccactacactcctcatcttcaaggctcatttcctttgcaaaacttcttgaaccatcactgacttgtacatttgttagcagtttctgggccaaatgcattgttggtcttaagagttgtctccgctgctttaagacccatttcgaactaaaaaataaaatcgctcgtttgttttttctttttctaacatcatttctatagtctaaaataaatacaaaataaacatcaggtaacaagttattagcgaaaacaaagctagaaatgcacattaaaatgatgtgtaacataatcgcatatattttaaaatgtattccagtatcaaatagcaaattcaacaaaaaagggaaattttcttcatccagttaaaagtaatttcttctgtttgcttaattcttcctctacagttttttaaagtaaactgtatagttaaccttttactacataagcttattaaacttatgccttaatttttgtgtcaacagagactacagtggaggctagtatgatgtttggcagaaaccaacacaattctgtaaagcaattatccttcaattaaaaaaataaaaaattttaaagggtgatgggtttttgtgattcaactaggcctagtgcaatgggacaggcaaacctatttggaaactgctggagaaggaaaaacaaaaagtcactacagaaaacatgaaggaactttcaaaaacattcttattttcatccttatcttagtctgttcaggccactaaaacaaaaacatcatagcctcatcttcccaggtagcactaggggtaaagaacccaatgtaggagacgtaagagatgtggattcaatccctattcagtgctctatagtgacctccatgggaatggagtctagaagagaatgtatatatgcatacgtatgggcttcccaagtggctctagtggtaaagaacccaccagccactgtaggagatgtaatagctgtaggttcgatccctgggtcaggaagatgccctggaggagggcatagcaacccactccagtattcttgcctgaagaatctcatgcacagaggagcctggcaggctacagtccatgggattgcaaagagactcaacggaagcaacttagcatgcacacatcgctgattcactttgctgtacagcagaaactaacacaacagtcatgaaattaaaagacacttactccttggaaggaaagttatgaccaacctagatagtatgttcaaaagcagagacattactttgccaacaaaggttcgtctagtcaaggctatggtttttcctgttgtcatgtatggatgtgagagttggactgtgaagaaggctgagcgccgaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaagagttgactcattggaaaagactctgatgctgggagggattgagggcaggaggagaaggggacgacagaggatgagatggctggatggcatcactgactcgatggacatgagtctgagtgaactccgggagttggtgatggacggggaggcctagcatgctgcaattcatggggtcgcaaagagtcggacacgactgagcgactgatctgatctgaacacaacagtgtaaaccaactatactccagtttaaaaatcagtttaaaaaaagaacactaatcatattcacgaaggataattagggagtttggaatggtcatgtacatactgctgctgctgctgctaagtcgcttcagtcgtgtccgactctacgcgaccccatagacggcagcctaccaggctcctccgtccatggaattctccaggcaagagcactggagtgggttgccatttccttctccaatgcatgaaagtgaaaagggaaagtgaagtcgcacagtcatgtctgactcttcgcaaccccatggactgcagcctgccaggctcttccgtccatgggagtttccaggcaagagtactggagtgggttgccattgccttctccacatgtacatactactatattttaaatggataacccacaaggacctactgtatggcacagggaattctgctcaatgttatgaggcagcctggatagggggggatttgggggataatggatacgtgtaaatatatggctgagttcccttgctatccacctgaaattatcacaacattgctaatcagctataccccaatataaaataaaaagttccaaagaaaaaaaatcttaacaacaacaaaaaaagccaaattatagatccggggtaggggggcagggaatggctcatcagttgaagaactgaagcctccagccaacagccgtgggagtaaaccgggaagccaatccttcagtcctaatcaaaccttcaaatgaatgcagtccctgctgaaatcctgagccaaaactacccagcaaagccgttcctaaattcctggccacagaaattgtgagataataagtatttgttgttttcacttcagttcagtccctcagtcatgtctgactcttttcgaccccatggactgcagtagcccaggcttccctgtccatcatcaactcccagagcttgttcaaactcatgtccattgagttggtgatgccatccaaccatctcatcctctgttgaccctttctcctcctgcattccatctttcccagtatcagggtcttttccaatgagtcagttctttgcatcaggtggccaaattattggagtttcagcttcagcatcagtccttccaatgaatattcaggactgattttctttaggatagactgattgggtctccttgaagtccaagggactctcaagagtcttctccaacaccacagttcaaaagcttcaattctttagagatcagccttctttatggtccaactctcacatccaaaaataactactggaaaaactatagctttgactagacggacctttgttggcaaagtaatgtctctgcttttgaatatgctgtctaggttggtcatagcttttcttccaaggaggaagagtcttttaatttcatggctgcagtcaccatctgcagtgattttggagcccaagaaatagtctctcactgtttccattgtttccccatctatttgtcatgaaatgatgggaccagatgccatgagctttgttttctgaatgttaagttttaagccaactttttcactctcctctttcactttcatcaagaggctttttagttcctcttcactttctgccataagggtggtgtcatctgcatatctgaggttattgatatttctcccagcaatcttgatttccccttgtgcttcatccagctcagcatttctcatgatgtactctgcatataagttaaataaacagggtgacaatatacacagccttgacatactccttttctgatttggagccagtcccttgttccatgtctggctctaactgttgcatcttgatctgcatacagatttcccaggagacaggtaaggtggtctggaattcccatctctgtcagctttttccacagtttgggacttctcaggtggtgctagtggtaaagaatccatctgcctgccgatgcaggagatctgggttggatccctgggtcaggaagattccctggagaaggaaatggaaatccactccagtattcttgcctggagaatcttatggacagaggagcctggcggggtacagtctctaggctcgcaaaaagtgagcctgaagtgacttagcccttagcacaactgaagtgacttagaacagcacagcacagtttgttgtgatccacacagtcaaaggctttggtgtagtcagtaaagcagaaatagatatttttctggaactctcttgctttttcaatgatccaacagatgttggcaatttaatctctggttgctctgccttttctaaatccagcttaaactggattaaacttaagtttaaactaaatccagcttaaacttaaaatggaagttcttggttcatgtactgttgaagcctggcttggaaaattttgagcattactttgctagcgtgtgagatgagtgcaattgtgtggtagtttgagcattctttggcattgcccttctttgggattggaatgaaaactgatctttttttttttttttctgtttgttgtcattgttttcttttttttttttaactttacaatattgtattcgttttgccaaatatcgaaatgaatctgccacaggtatacctgtgttccccagtcctgtggccactgctgagttttccaaatttgttgacatattgagtgcagtgctttcacagcatcatcttttaggatttgaaatagctcaattgaaaattccatcacctccactagctttgttcatagtgatgcttcctaaggcccacttgacttcatattccaggatgtctggctctaggtgagtgatcacaccattgtgattatctgggtcgtgaagatcttttttgtatagttccttgtattcttgccacctcttcttaatatcttctgcttctgttaggtagcagaaagatattaataaagcatgtttctgtcctttattgtgccatctttgcatgaaatgtaaccttggtatctctaattttcctgaagaggtctctagtctttcccactgtgttgctttcttctatttcttgcgttggtcactgaggaaggctttcttatctctccttgccattctttggaactctgtgtttaaatggatgtatctttccttttctcctttgcctttagattctcttcttttctcagctatttcgaaggcctcctcagacaaccattttgcctttttgcatttgtttttcttagggatggtcttgatcaccatctcctgtacaatgttaaaaccctccatccttacttcttcaggcactctgtctatcagatctatacccttgaatctgtttgtcactttcactgtataatcataagggatttgatttaggtcatacttgaatggtctagtgggtttccctactttcttcaatttaagtctgaattttgcaataaggagttcatgatctgagccatagtcagctcctggtcttgtttttgctgattatatagagcttttccatctttggctgcaaagaatatctgattttgatattgaccatctggtgacttccatgtgtagagttttctcttgtgttgttggaagagggtgttttctatgaccagtgcgttctcttggcaaaactctgttaccctttgctctgcttcattttgtactccaaggccaaatttgccttttactccaggtatctcttgacttcctacttttgcattacagtcccctataatgaaaaggacatttaagtcactaaaaaaaaaaaagcaaacaaacaaaaacactaatcatattcacaaggattccaccacaatgacttaattgtctcccaagggccccacctcccaatatactgcactggggattattaggtttcaacacatgaatcttggggaggacacaaccattccatctacagcaaattttttgttcacaaagcaagctgctataaaaatgaagaagatatcttagaggctttttttttaaagtacatcaaaataacttcaatggggatgctgaatagtataaagaacatatctgaaatccaatgcatgaataactaaaaaaaaaatttcaaaaaaacaaaagtcaaagaaatagacattttaagactaagataagaaatatgaggaaagatctaagagagtcagacacttaaatgggttccaatagacaataatttacttggaagagaagccataatccagtaagtaataaaagaaaattcccctgtgccaaagaaagacttgcattttcacatcaaaggaacacaacaaacacaagtcaggaatactaaatagaagacggtcaaccgaaactgccatggtgaaatgtctttcatttcccccagtttctttgagggataattaacaaataaaattatacatatgtaaagtatacaatataatgagttgatagatgtgtacactgtgaaataattattgctctgtcttgggtttggagacaagatcgtaaggaggcgagagagaacgaaccaagatagagtctactgcaatgatccaagagatatgtgttttggacaaggatggtgttagcagaagaagtggagatttacactgaagacagaaacaacagaatttgctggtgtattgaatgtgcagggtataagagacaatacaagtttgattctcaagttgttgacctgagtaactggattaatcatttaattaattaacataaaaactggattaataaggtgtcattttctgagatggtgaagaagagaggaagaccgagtctggatttggttttggacatgttaagtttgagatgcttactgaacatccaagtggagacgtcaaactggcaggtggaatttaggaaaaaggtcaggactgaggatacaaacttcaaaatctgcgaaagatgttgtttaaagccatgggaccgggtgagatcacttaaagtgtgaggtacatgaagaccagaggtctgaaggctcactcttgtggtattccagtattaaggagttcagaagagagaatcaagcaaaagagaatgagaggaaatatgctagaagtaagagaacagtgggattctatgttgtcatagaagccacaggaggaaaatgactttaagaaatcaattcagggacttccttggtgatccatggttgagaaactgccttgcaatgcagggacaagggttcgatccctggttggggaactaagatcccacctgctgcagaacaactcagtccatatgagccacaactagagaagtcttcacactgcaacaaagatctggcatgccacaactaagacccaacatagccaaataaataaataaatgttgaaaaaaaaaaagaaatccgtacaaaaaatcattgacagtgtagttacacgacttaatttaatattgtttgaaggaggcttgaaatagaagacagtgttttttcaaaaaattttctgaacagtctgaggagtagtttgctgctgctgctgctgctaagtcgctttagtcgtatccgactctttgcgaccccatagacagcaaccgaccagactcctccatccctgcaattctccaggcaagagtactggagtgggttgccattgccttctctggaggagtagtttgaggtggtagttaagagcttggggaaaatgagacaaggtgtttaaaacaaacaaggtacctggcacgtgacactcaataagtaatacttatatttccactatcattatcagctacaaaatctaggttgtagagaggtgagtagggagaataagaacattaaattctcagactgtggaaataaagaaaggaaggtgatttataaatgctatttaattcttgatgttgatggataaatgaaatgtggcttaaaataggtttgttaaaaacttagaatatctagggacttctctcgtggtccagcagttaagaatccagctgccaatgcaggggagaggggttcagtccctggtccaagaagatccacatgccatggaacagctaagccagttccacacaactattgacccatgtatcctggagcctgtgctcgccaaccagataggctaccattgtgagaagcctgagcaccgcaactggaagggagccctcgcttgctgcagctggagaaagcacacatgcggcaacaaagaccaagaggggccaacatttaattaattaattaaaatttaaaataccaaagaataaaattttcccccacctttttaacattttcttttcttatttttatttaagttttattgtggttgttcagtccctaagtcatgtccaacactttgcaaccccatggactgcagcatgccgggctcctctgtcctccactatctttggagtttgctcaaactcatgtccattgagtcagtaatgctatccaacaatctcatcctctgctgccccattctcctcctgccctcaatcttttccagcatcagggtcttttccaattagtatttttgcattaggggcaaagtattggagtttcagtttcagcattagtccttccaacgaatagtcagtgttgattccctttaggattggctggttggatctccttgcagtccaagggactctcaagagtcttctccaacaccacagttcaaaagcatcaagtcttcggtgctcaaccttcctcatggtccaactctcacgtttatacatgactagtagaaaaaccataactttgactatacagagctttgtcagcaaagtgatctctctgctttttaataccatctaggttgtcatagcttttctttcaaggagcaagcatctttccatttcatggctgcagtcaccatccaaagtgattttggagcccaggaaaataaactctgtcaatattttccattggttcaccatttatttggcatgaagtaatggaactggatgccatgattttaggtttttttaatgttgagtttcaagccagctttttcactctccgttttcactttcatcaagaggctctttagttcctcttcactttctgctattagagtagtatcatctatatatttgagtttattgatatttcatccgacaatcttgattccagcttgtgcttcatccagtctggcatttcacgtgatgtactctgcatataagttaaataagcagggtgaccatatacagcctttcttaatttggaatcagtccattgttccatgtccagttataactgctgcttttgacgtacatacagatttctcaggaggcaggtcaggtggtctggtattccatctctttaagaatttcccacagtttgttgtgatccacacagtcgaaagctttagagtagtcaatgaagcagaagtagatgtttttctggaattctgttgctttttctatgatccagcatttgttggatatttgatctctggtttctctgccttttctaaacccagcttgaacatctggaagttcttggttcacatactatcgaagcctagcttggagaattttgagcattagtttgttatcatataagatgagtgcaattgtgaagtagtttgaacattctttggcattgcctttctttgagattggaatgaaaactgatcttttccagtcctgtggccactgctgagttttccaaatttgttggcgtattgagtgcaacactttcacagcatcagcttttaggatttgaaatagcccaactggaaattccatcacctccactagctttgttcatagtgatacttcctaaggaccacttaacttcacattccaggatgtctggctctaggtgagtgatcacaccatcatgattatctgggtcatgaagatcttttttgtacagttcttctgtgtattcttgccacctcttctttatatcttctgcttctgttaggtccacaacgtttctgtcctttattgtgcctgtctttgcatgaaatgttcccttggtatctctaattttcttgaagagatctctagtctttcccattctattgttttcctctatttctttgcattgatcactgaggaaggctttctcatctctccatgctattcttcggaactctgcattcagatgggtatagcttccctttcttacttcccttttgcttctcttcttttctcagctgcttgtaaggcctcctcagttaaccattttgcctttttgcatttctttttcttgggaatggttttgatcaccacctcctgtacaatattacaaacctccatccatagttctttaggcactctgtctatcagatctaatcccttgaatatatttgtcacttctactgtataatcaagggatttgttttaggtcatacctgaatggtctttccctactttcttcagtttaagtctgaattttgcaatgagaaattcatgatgtgagccacagtcagctcccggtcttgtttttgctgagtgtatagagcttctccatctttggctgcaaagaatataatcaatctgatttcaatattgaatatctgatgatgtccatgtgtagagttgttccttgtgttgttggaagagagtgtttcctatgaccagtgcattctcttggcaaaactctgttagtctttgccttgcttcattttgtactccaaggccacacttgcctgttactccaggtatctcttaacttgctacttttgcatttcagtcccctgtgatgaaaaggacatctttttttggtgttaattctagaaggtcttgtaggtcatcatagaaccgttcaacttcagcttctctggtattagtgattggggcatagacttggattactgtgataatgaatggtttgctttgggaatgagccaagatcactctgtcatttttgagaatgtacccaagtactgcatttcagactctttgcttgatgatgagggctacttcatttcttctaagggattcttgctcaaagtagtagatataatggtcatctgagttaaattcacccattctggtccattttagttcgttgatttctaaaatgttgatgtttactcttgccatctcctgtttgaccacttccaatttaccttgattcatggccctaatatcccaagttcctatggagtatttttctttacagcatcagactttacttccatcaccagtcacatccacaactgggcattgttttcactttggttccatctcttcattctttctggagttattcctctgctcttctctagtagtagactgggcatctaggcacctaccaacctggggagttcatctttcagtgtcctatctttttgccttttcatactgttcatggggttctcaaggcaagaatgctgaagtggtttgccattcccttgtccagtggatcacgttttgtcagaactctctaccatgacacatctgtcttgggtggtcctacacagcatggctcatagtttcatcgagttagacaaggctgtggtccatgtgatcagtttggttagttttctgtgattgtggttttctgtcatatttatttacatactataaaaatctcctttctaaagtttacaattcagtatattttagtaatagtcacaaagttgtacaactgttaccattattttactataatcaccacaaaaaggaacctccataccccttagcagtccagtcccattttcccttccccacagcggcctatccctgacaatcacaaatcttctatttatctctggattttcttattctggatattttatattaatggattcatacaacttgtggtctttgatatttgatttctttcatttagcatgatgcttttaagattcatcatgtggtattatgaatcattacttcattccttttattagcgaaataatattccattatatggatataacacattttgtttatctgttcatcagttgatgggattttaggttgttttcactttgtgtgtgatactctgaacaacgtatgaacatgaatgaacattcatgtaggaggatttgtgtgaacatatgaggtcatttctcttgagtatgtatccatgagaagaatttctgggtcatatggaaactatatttaactctttggtgaaatgttaaactcttttccagagcaattgcacaattttgtattcttgtcagtaatgtaggaggagtttagtttctccacatcactgtcaacactcattattgcctgtctttgattataacaaacctaatgagtgtgaaacagtatcttattgtggtttttatttgcatttccctagtgattaatgatattgatcatattttcatgagcttaatagccatttgtaatcttcattggagaaatatctattcaattctattcccacttttaagttggattatttgcctttttattgttgaattttaagttttttcacattctgaatactagacctttatcaagtttatgatttacaagtattttctcccgtactgtggcttgtcttttcactttcttgatagtgtacttcaaagcacacatttttaaatttttttttaaaatccaatttatctatttttcctttaattgcttgtggtttggtgtcatatctaagaaaaagttgcctattccaaggtcacgaagatttacacctatatttttttctaagggtcttccctggtggccccgatggttctaagagttcttcagttttagctcttatacgtaagtctttgattcattttgagttaaattttgaagatggtaggaggtaagaggtacaatttcattcttttgcactgtggatacccagttgtcccagcatcattttgttgaaaagattatttttccctcattgaattgtcttgcagtgctgttgaaaattaatcaaccgcaaatgtgtgggtttatttctggactctcagttctagtccattgtctacatgccagtaccacacaatcctgactattgcagcttaagtttcaaagttggaaaatgtaagttctccagatttcttctttctcaagattgttttggctattatggatcccttgtattttcatatgaattttaggacaaccttgacaattttttcaaaaagcaaaaacttgaactgtgatagaactgtgttgaacctgaaaatctctttgggacgtattgccatcttcctatctgtgaacatagggtgtctatttatataggtctccagtttttttcacctaatattctgtagtttctagtgtacaagacttgtacttctttttttaaatgtatcttgtggatgctattgtaagtgaaattgctttcttaatttcatttttggaatgtccattgctagtgtatagaaatacaattggtttttgtatactgattttggttttcttttttgtagattccttaggattttctatatatagaaactttttccttttagtttgttagccatagtttccttcagctttttagaacatatttaacaagactgacttactttgcatggtaaatccaatatctgtgctgcctgagagactgcttctatcaactgcttttctgcctatgtgagatatttccttgcttctttgcatgtctcataattttttgttaaagattaaacaaataaaatagcaaattgattgctaataaaactgaacaaattgttaaacaaattgaacaaatcgattgttaataaaattgaacaaatctgattttcagattccatcccaggttttgttgttgttgatgttgtttgttgtatgtttgttgaattttctgaactaattctgtaaagtgtatattccttgttgtatgagaacactgaagtctttgattagtggtcagttaatgattcaggaaaggagtatgtcaaggctgtatattgtcaccctgcttatttaacttatatgcagagtttatcatgtgaaatgctgggctagatgaaacacaagctagaatcaagattgctgggagaaatatcaataacttcagatatgcaaatgacatcacccttatggctgaaaacaaagaagaactaaaaagcctcttgatgaaagtgaaagaggagagttaaaaagttggcttaaaactcaacattcagaaaacaaagatcatagcatccagtcccatcacttcatggcaaacagataggtaaacagtggaaacagtgagagactttattttggggggggttccaaaatcactgcagatggtgattgcagccacgaaattaaaagatgcttgcttaatggaagaaaagctatgaccaacctagacagtgtattaaaaagcagagacattactttgcccacaaaggtccatctagtcaaagctatggtttttccagtagtcatgtatggatgtgagagttggaccataaggaaagctgagcactgaagacttgatgcttttgaactgtggtgttggaagagactcttgagagtcccttggactgcaaggagatccaaccagtccatcctaaaggaaatcagtcctgaatattcattgaaaggactgatgctgaagctgaaactccaataatttggccacctgatacaaagaattggaaaagaccctgatgctgggaaagattgaagacgggagggcaaggggatgacagaggatgagatggttggatggcatcaccgattcaatggacatgagtttgagtaagttctgggagttggtgatggacagggaggcctggggtgctgcagtcaatggggtcgcacagaatcccctatgggtatccattgcccagattttccttttaagctttttggttagcctcttgcttgtcccaactcttattctaccacctcaggtgatcatgctgttcaataattgcctctgattgttttcaacacacacctctgtggaaaagactgttggcagtagacgaactctgaatgagagaaaataaagacagtctcactaggtggggggctctcccaaagaattatcagacaggtcaattatgacattactcaaaggatggggcttcgaaggagcttcaaccccattctgctccctccagtagctgttgggttgctggttttcactgtgatttcaggctgttggattttgaggctgctgtggtgctgcgggtggtggtgggggcgggggggctctaatggaatatgacaagagaaaattacacaaagctcattgttcccgccaggattcagctatttttcttgaacaaatgctcccagattgctgcaagcttctggttaatttccagagttctgaaaatgttgattctaacttttttgccagcatttttgttgcttttatggaggagagaatttttggaggtccttatttcatcattttttgctggcatcttaaaatgcaattttgatggagaccttcaaacctctaaaagtatgctgtctggtactgtagccattagccacatggggcgattgaacccttaaaacatggctagtgcaaattgagatgtgctgtaaatataaaatacatactgaatttcaatacagtaaaaggcaatacaataaaaaagaattttaagtatcttcttaatgacttgttactttgaatatattttttaaattggagaatatctgcttgacaatgttgcattactttctgctgtacaacagtgtgaatcagctataagtatacacatacccccttcctcttggacctcccttccaccccacccccaccccacccgtctacgtcatcacagagcactgagccgagctccctgttttatacagcagcttcccactagctacctattttgcacatagtagtggagaaggcaatggcacctcactccagtactcttgcctggaaaatcccatggatggagaagcctggtaggctgcagtccatgaggtcgctaagagtcggacacgactgagcgacttcactttcacttttcactttcctgtattggagaaggaaatggcaacccactccattgttcttgcctggagaatcccagggacaggggagcctggtgggctgccgtctatggggtcgcacagagtcggacacgactgaagcaccttagcagcagcagcagcagtgtatatgtcgatgctactctttgaattcatcccaccctctcctccctgtgctgcgtccacaaatccattctctacatctgcatctctattcctgccctacaaataggttcatcagtaccatttttctggattccatatatatacattaacatgtgatacttgtttttctctttctgacttacttcactctgtataacaaactttagttttgtctacatcactgcaaatgacctaattctattccatttttatggctgagtaatattccattatatatatgtaccgcaacttcctttttttttttttttttaagtaatgattccatttagcttgcataattgtcaagcccaaagagacttacaggtgtcctgatcaaacaaaaaatcacaaagaatcaaataaaatgagcaataactcccatgtccctctgtgattcacctgtatgtttggaattcagcacctgctaccctcgtattcatagcattgctgcatctctttgcatacatccacgaagactcaagacaaggcgcataccacaacttctttatccattcatctgtcaatggacatttaggttgtttccatgtcctggctgttgtaaacagtgctgcaatgaactgcactggggtacctgtgtctttttgaattatggtttccacagggtacgtgcccagtagtgggattgctgggtcatgggagttttattcctggtttcttaaggaatctcgataccattctctacagtggctacatcaatttacattcccatcaacagtgcaagaggattcccttttctccacatcctctccagcatttattgtttgtagatttttctatgatggccattgtgaccagtgtgagatgacacctcattttagtttgatttgcatttctctaataatgagaaatgttgagtatcttttcatgtgtttgtcagccatctgtatgtcttctttggagaaacgtccatttaggtcttttgcccacttattgatcaggttgtttgtttttctgatattgagctgcatgaactgcttgtatattttggagatgaatcctttgtcagttgcttatttgtgattattttttctcattctgagagttttcttttcatcttgtttatagtgtcctttgctgtgcaaaagcttttaagtttcattaggtcccatttgtttacttttgtttttatttccattactctagaaggtgggtcaaagaggcttttgctgtgatttatgttaaatatatgttgaaataatatattcattatcttggattaagtaacatatgttattaaaattaatttcatattttaataaaccatttttaatgtgtgtgggagtcagaattctcagatgatccccaatgagtcatgtcttcatggctgctagaaaattttacattacatatgtggctctcattagctttctattggagagtgttgtctggaatgaaaaaagcacaacgaaaactactaatctggtaaaatgaaacaaaaaatctattaaaaattagaaggaaatagcaagaaagaatactaaacagaaaacatgaaacatggctacaggaatgagactaaacatatttgttagattctgtatgatgcaaggaaaagtgaaagttagtctcacagttgagtctgactctgctatcccatggactatagcctgccaggtcctctgtccatggaattctccaggcaagagtactggagtgggttcacatttccttctccaggggatcttcctgacccaggaattgaacccaggtttcctgcattgtaggcagattctttaccaactgaggtactagggaattcctagtatgatggaatactccgcggacattgaggtgataggcattgtcttgactggttcgtgggacatggactctgagatggaggtttggaggctggagctttgctgggaaatgccctcagagacaacacctgtacaggagtgaaaggagcaggaggatataaaaggagaaattcaactgaaatacaggtggaccaggagtctcagctgtacccactggagactctgacgctgggaaggcctttcagagtgaaggctgagcctttagaaccctgcattgaccagcccctggatgtgatctgtcccctgggagaacgggtcactttgaacaagagcaattccagggcgaggacttagctgtgatctgtcaccagtgagcttccagacagctgaggcaatgagtgtctcacttttgaaacaggacctggggagcacaccacaccatccactgtagtgtcgtacattaagtgaaaataagcagattttacataccggttcatatgttaagtattaaaaagtatgtttatatgcaggcaaatcactagcagagactgttttgggagagctaaaggaagagcttcttgatgtgggtgaaagaggagcgtgaaaaagctggcttaaaactcaacattcaaaaaacgaagttggtggcatccaatcccatcacttcatggcaaacagatggggaaaaagtggaaaccgtggcagattttattttcttgggctccaaaatcactgcagacaatggcagcagtcataaaattaaaagacgcttgctccttggaaggaaagctatgacaaacctagacagcatattaaaaagcagagacattactttgctgacaaaggtccatagagtcaaagctatggtttttccaggagtcaagtatggatgtgagagttggaccgtaaagaaggctgagggcagaagaattgctccttttgaattgcagtgttagagaagactcttgagagtcccttggactgcaaagagataaaaccagtcaatcctaaagaaaatcaaacccaaatattcactgtaaggactgatgctccatactttggccacctgatgtgaaggctcattgggaaagtccctgatgctgagaaaggttgagggcaggaggaaaagggggaaacagagaatgagatggctggatggcatcaccaactcaatggacaagggtttgagcaaactctgggagatgatgaaggacagggaagcctggcatgctgtagtccatggggtcacaaagagtcagacatgacttagtgactgaacaacaacaaaggaagggttggcaggggctatgatggggaaaaaattcatactttcagctattctagttttttataatcttcataaattatggggatgcatgcatgtgcactaagttgcttcagtcatgtctgactttttgcaactctacggactatagcccatcaggctcctctgtccatagggattctccaggcaagaatactgaaatgggttgtgggccctcttccaagggaatcttcccgatccagagatcgaagccacacctcttacatcttcagcactggcaggtgggttctagaccactagggccacctgggaagccaatggtggacagtgaacagatggaaataaacaggtttccagtacaggtatcccctgtggtgatcaactgtgggtcaggattacaaagcttccaattagaattgccttctgaattttgtctccaacgtgtcccaagactcaaaaaatagacaacagcccaggtagttctgacattaaatagaatgatcccatctttactggcccttctgggccagaggacagctgcctcattgtacaaaactcatcttttttaggccatatgtcttcttattttattatttccgtgactttcttactgacccctgaaaaaaaaaaaaggctaacatcccttctggaccttgtcagggtcttttctcaacttgattttctcaatcatctaaacaaagacaacacttagggagtcctttcatcctgaaagaaccatggaggcttttccaagcaaaggaatgcatggcacctgatgccacaccgaatgacaactatttaatgactacttgccccaaacaacagcaatttaatgatcagtgtaataaaaagcattgaccaattagaatgaacacagacccttgcggacattggaaagtgtccagtcaatggttatttggcaaccaacatgaaagtagttcaatattttaatagactgagctgaacatgccaaatatcagtcctgaccacgggtgcaaatgcagacacatgaccaggagtggaggtcagttaagcttactgggtaaacgaatggtctcaaatccacagtggcctcatgatccttctaattaagtccaggaacatgtcagatggacaggaaagcacacgcacgtcattcacttatggctcgccctcctggttccccatgatttaacttgagtcaccagcatctgcaggtctgtcgtgcacttcagttcagtaaagatggaggagcccaaatacagggcgaatagtcttcattcatggagaaggcaacggcaccccacttcagtgttcttgcctggagaatcccagggacgggggagcctggtgggctgccgtctatggggtcgcacagagtcagacaagactgaggcgacttagcagcagcagcagcagtcttcattcgatagaaagtccatgtgtgcgctaccggctccaacaaaccaggattgggaggcaggaaaaggaaaggggagggcagctattacactgtaaaattcctccggacctggggtaaattgaaacattgttttaaggaattgtaggtatttccaggcaggagaaatatgagatcagctccatcgaactaatgttgactttaattttaagtagtgttccttgggcagaaatctaaaaccattgtggacaaatggttgttctaaaacacctcaccgtgggcagagcactgagggtttaggacatgctgttgctttttactaaattgaagaactgcacaagctgtctctttccatcgcctctgaacttggtcctttgacccctgtatgggtcaaatcaggtgatgagcctctccaaagtctcatctccctactcagcccaaattgcctccctgggtatccttcttctctctgagttacaaccttctccttgcataccatcctcccgagaaggtacacccccctccctgagtcccaacctcctcccaggctccaagtcaatctctgggtgctcatctcctcactggtgccatttcccaccaaggacaaatgctctctcattctgcctgaatgtgtattgcctcccaaccaagaataattatcacctgcttccgtgtggccttggcagtggaccaagcacattcattcacaaagtctcttggatcctcttcatcaccctgggaggaagtcagggtggtagaaccttccgtttgacagatgaggaagtgaggacatagcgagagtaaacaactccgccctcttccccatcttcagaccctggtgccctggtctttccatggtgctctgcggcatcacggcgcccgccggggtgtagactttgttccacctgaagaggacacgtgagtgcccgtacccccatgaggctggcacattccagaaccacagggccaggctctcagggtgtctagtttgggaaatgatggggaggtgtgagcgcctgaaagaagttgccctactgtttcccggcctcgcttccaaagaagctgagaagatcaagagatgatgcaggtcaagcgtgtattgtcaagactggtccaacaagaggccggcgttgttgcgagtttggtagagacaaggctcaggaggaaaatctccttgtaaaccctgcgcagcccttttcccgccaaggacagttacccaagcagttccacagctcacttggcagtgtcaagcctggggccctgtccaaataacttcctttgcaaggccatgcaccacacctcccaggaggcttccacttttgtgcaagctcatgctcataccacatgccgtgctcacattccagagctttatgactgcgcagcagggagaggacttgtcctgccgtgtgcaaagagggtgcccaggccaacatccggccaggcttggcatgggagccccattcagtcactgctgagggaccatccaggactgagatccaggatggatccagccccctgatattttacaagactccccttggctccaaggggtcccaaacgacagccaggatcttgagttccaaaggtcatcagaacagccagcagaccaccgaaatataccagggtttatacggatgtaagctcagaagctccaaaggatgtactgaatttaagacgggctcataggaaagatatggcttagaaggttacagtctatgcaggtactactatgtgggtattgtaaatggaaagggatgggagtagtgtttcaggaagctgacaggccattaacaacaacaaaaaaaaactcagtgatctgaatgggcttgaggatcatggggggataaaccagctgacccccaaattcacaccagatctctcaggtgtcaaaactgggctcgccaagattgcatctagaaaacaattgcctctttgttcttgagtttaacctcagaaaactaccagaatctggagagatcagggttggaagtggtcctggcgaattttctataggtgaaaaaaaaaagcgagaataacagtgacaacaacaaacaccagcagatctggcaggattttccctcccttccctgcggccttttctctgagtgttttatcaactactgttgtgggaggcatctgggctactggtgtttttctacttaaaggagcaagaaaattccattcactgaagaataacatggttgactgccccaacgggaaaggcattcagcgtgctgcgttcttgctttctgggtcgctgtcaggaccccgaggtccagactggctggctcctgttccctgggtcacccaggcctctggggttgtgactcccacccacagagagagtacagtgcgtgctaatggggcacacagggacagagggaagagggtgggaggcaggtgaattatttccttttcaagaaaaataaataaataaagacaaaaaaatccttgcataaatctgtcctagagctcacactgtgggctctggaaatacaatcaggtcctggaatcatccagaaagcatccaggaattgactcccacccatctcagcaatctcaaccttattattttttgtgtgttttttaaaagaggatcaactatcaagtgtgttggtggatatataaaatggtatagtcactatgaaaactggacattttctataaagctaaacacacacctgctctatgccacagcaattccattctgaggtatatttacccaagagaaatgaaaacgcacgacacacaaggacctgtgtaagaacacgcctagcagcttgattcagaagagccccaaattaaaatgtatcacgaagtgaatcgataaatccactgtgataagcacctctgtccatggaattcaccaggcaagaatactgcgcccttcgccaaggggtcttcccaacccagggattgaacctgggtctcctttgttgcaggcagattctttaccatttgagccaccagggaagacaggtataaccatacaatggaataataataatttcctgttgctagtataacaaattcacacaaactgggtgactgaacacagacttattctccgatagttctggaggtcagaagtctgaaatcactttcacagggttaaatatcaaaatgttggcacagctggttccttctggaggctccaggagagaatgtttccttgccttttccagcgtccagtgacccctcctgtatcccttggctgatggtcttttcacagtgtatcacttcgatctgtggctctggtcacatttccttctcatcctctgaggtcaaacctccctctacctcccatgtatttgtgactacacttaggactacttggaaaatccaagctagtctttccatttcaagttttttgcttaatcacacctgcaaaagtcctttttgtaacataaaataagatccataggctccaggaattagaacctggatatctttgaggccagtattcagttgaccacaggaaaatactacccaggagaagaggatgagctgctaacacaggcaccatgagtgaagtttgcaaacaggatgttgagcgaaagaggacagaccaaaaaaagagaaaacatgtatgattcaatttatatgaagtttcagaagaggcataagtaatctatgctgatagaaatcagaacagtaattgcctagaggtaaggtaatttaccgggaaaggacacagagaactttcttgggggatgaaatgttctgtatcttgactggcaagtgtacaggaatgtgtacatttatcaaaactcatggagctgtacactccagatctgcacatttcatagtgtctaaattgttccttgggcttccccagtgactcagtggataaagaaatccacctgtgatgcaggacatggtggaaactcagggaagggggaaatggcaacccatctcagcattcttgcctgaaaaatcccatgagcagaggagcttggtgggctgcagtcccaaggggtcacaaagagtcggacacagctgagtgactgggtacaaactgttccttaatggtaaaaaaaaaaaaaaaaagagtgtaaacaacaaggaaaaaaggaagaaagagggcaggcagagtaaagcaaagctcaatgcatattttttagggaagtttaatttttttattttggctgtgctgggtctttgttgggcttagttgcaggcttagatcccgctggagcatgtagaatcttagttccctgaccagggatcaaactcacgtcccttgcattggaagggggattcttaaccactggaccgctagggaagtcccaagaccaaagtctttaggacacattttcctccctcactgtcaccaagacaagctcttgtagtagaaggaacctggactcagaggagggaggacctgggatctcacgcacctgaggtcagccaacctcctgcagcttgtagcatttaaggtacctgaagtctaccttgaataaatttacaagacaagacacccaatgaaaaaccttaaatatactgaaaacctccttcctctcacaagtgagagaataactattttttacatagcaacggttttcactttcttactcccttctagaacttttacacagttccgtatattttctagatcattgttatcatgccagacggatcatttattctctgcctttttcattcaacatcacataaaaagatgtttctgttttgctagagagtcgtcataaacatcctctttgatcactggatgatatttcagtgaggtgactgaaatcataattcagttagccttttcctttttattggatattaggctatttttttttttttttttttttgctccctgtggaaaaataatggagctctggttgactttgttcttcttttgaattatttaagaaatgaatattggaataagaaatcaagaagaggagaaggaagcagcaaagaaacctgtagcacagaattcagagcttaagggacctccagaatcatctagtctaaaatcctaattttacagcagaaaccaaggtcagggcacatctgaagtccaacgctccagttgaggcacagagttaagacccaagctcagaagccctgaatttaattcaaacaaaataagcacaagctatgatctctgctttgcctatacagcaagcatcaacagggacaaatttctcccatctaaccttgtcttaaagttgtgtctatcagataaattgtgagagaagttaatttaaacagaaaagaatagttgattaacagagacacagtgtcgtacacacattaaataaacaacgagggcctactgtatagcacagggaacggtattcagtatcttataacaatctataccggaaaagaatctaaaaaagaatggatatatatatatataactgaatcactgtgctgtacacctgaaacaatgtaaatcaactctacttcaattttaaaattacttaaataaaaaaaagaacctataatgctggcctaagattagaatttaagttaccctttagttcagctggtaaggaaaatactacatctgaaaaatggaaagaagagacttgtctttgcctttgtgtgtctgggagatcctctgattacatgggtgttgatgtgaaagacagttggctctcaattaactggactaatagcaggaaaccctgcggtagatcacaaaaaggagaaccaaaggcaaaaataatttgcaagtgccttacataattttccagcaacagattcaccttcttacatttgccacaaaacttgggttcctagaatattcatcagttggagcatagaacgtggcttgatttagatcttgttaggaggaggaagataacagctatttacaatgtgcctacttagtgccaggcaataaaccagacacttttcataccccccctggtggatttttatccccagtaagtaggaatctgagcctaggctacagtaagtaactttcccaaggtcactcaattacagtatcaaagttgcagccccgtctgaagctgaaacccacattttcaacccaaccggaaaaatcagatcacattttgttcaacaaatatttatgggccaactatgtttcaaatcctgcttgctaagtagcaagggtataaaaataaataagagaaatagcattcctagtaaagcacaatccagcaggtgaaaagagaagcagtgacgcatagtagattctacataaatattggatcaaagagggaatgagtcctctcgggtttgtgaagctgttcatatctgtccggtgggtcaatgacagactgggggattttttttaattttatttttttcaagtatagttgatttatgatgttgtgttaatttgtgtgtacagtaaagtgattccgtggtacatatatataccttttttaacatatgcttttccattgcggtttatcacagggcattgaatatagttccctgtgctcttcagtaggaccttattgtttatccatcctgcatataataattttgatctgctaatcccgaactcccaatccatccctcccccttcactaccccttggccacaagtctgttctctacactgtgagtctgtttctgctttgtatgtagataagttcatttgtgaatgacaggctttaaaaaatgccaattgacataggcatattcttgattgtttcttacagaatgtgaatttcatgcaaatattcaatcttactctaactccgacacaaaagtattttgattcccacttcctagtgtgttgtaaaacattatccaagtctgagtttcctaaaacccagaccagtcttcacctaaaataaaatataataatctaaaagggtaataacttgtttaaacaatgtaactaaattcatgatttttaaatgggaatattttgtgttgttaagtttaaaaaaaaaacaattcactaatttaaaacagtttagtaataggaaaatttgttatttctctttaagaaaaaaatctagaaaaagcacatccccagcttgattaaactggctatttgtgatgtcatcaaggacttagtttctttgcattccccacccaccctgcccccaaaactttcatctttagcttgctagattaattgccttcatggtttgcactgcggctgccataattccagacatcacatgaatggcttttcaactccagctcccaaatacctctccccaaactgcaatggtcctagttcacactgtcgccattttgatcccagacaattgtaggagtttcccatagtgcccagctgtggaaacccagatattattgtcattttcacattaaacatttcgtttgtccttattaccctcgaaagaaaatccaaactctttaacttggtttacatggcccttcaggatctggcccaacctaccggctagtttcatatctccatatctcagctttccaggtggctcaattgtaaagaatccatctgccgatgcaggagacataggagatacaggttcgatccttgagttaggaagatcccttggagtaggaaatggcaacccactccagtattcttgtctggaaaattctatggacagaggagcctggcaagttacagtccatggggtcacagagtcagacatgactgagcgcacacacacacaggttaatgctccagccaaaccaaatgctatagggtaaatggttgtatccccccacctcaaattcttatgtttaaatctgatccccagtgtgatggtatttggagatggggccttagggaggtggtttgttatgaaggtgaagccctcaggaatgggattagtgcccttatagaagagaccccagagagctcccagtcccttctcatgaagacaatatgagaagatggccaactgagaaccaaaaagagggccctcaccacacatcaagtacgctagcaacttggcattgaacacccagcaaccagatctgtgagagacagatgtcagtggcttgtaagctccctaatctaggatactctgttatagtagcccctacagaccaagacaccaaacccatctgtgctctacagctcctgatccttgcttatgcttattcctcacctagaatattccttcctgttcatctaacacttacatttcccaataattcattcaacaaacatctgctgagtgccttctctgcaccatgaactagtctaggtactgagaataaggatactgtagggaacaaaagaaagtatctaaatttatgaccttatattttggttgagggagacagacacaaagcataaacaagtagccatgtagtgtgtgtcagatggtaataagcgcattaaagaaaaataacgctagatgggggacagggtgtacaagaggctgggctaactttttaagtaacgtgggtatgagagtcctcacccagaagatgacagttaagctcagcttggacattccttcttcctagaagccttcttgaaattttccaagtccaggttaagtgccatatttatgaacttccacacgatctctatttccccattataatacttcacatgtcatagagtatttttctgtttatttgtgtgtgtcaattgtaaactcgggggcacagggaattgtagatattcatgctgtttgctgaacccacaaatgaagtgaccacctacattatttataagtgctacagataatttatgtaacgtttatggcagtagtgctgtgtttttacaaggcactcctgcacacttggcctcatgcgagacaggcaagtggcattgtccccttttaacagactctccaaaaagttacatttcttgcccagggtgtcacaatgagaagaaattccagctcaatcccacccctcacatctccagaaccaatgtgctttccagaaaaatcccactgccttcctgaagcatgttctgtaaaaacacgaaccactcacccaagcacacttggcgtgctcagccaacgtctattcactttttatcacgaaaagaccttggctcttccccggggttcccatattcccaccccctaggaagctttcaccaaatgctaaagccacggtgtaaacccagaggtaaaccttcaggaattccttgatggagctgctgcacggtctgcctgccttttcacactattttcccaaatgtttactgtaagcgtactcctccgagtatgcttctagcagatccaattcagacaatcacagagtggggatccactgaaatactctcactgctggcacttttcagctgatgttgcctttgcgatgtgttaattaaaacatgtggggttcataaaagctgcaggcagaatcgcagatgggagtcatttagcaataatgaacaccctccggccccagcctccccaccctgcttgctgacaaactgtcactacgtttggacaagaggaactgagaaggggctgactgggcaaaaaagtcagtgtttggcaaaatctctgccccttagagctgtcccatgtcaaagaagcacaggggagggaagtgaacccaggctcccctcatttcagagaagtgatttaagcggcaggcagggttgaacagttcttggtagttttccacttgctgctcacaagtcctgaccctctttggttctttgtcacttggctccataaaaacacccacttcagggaacttgaacacttgctcacaccacccaccgccccactggcatgtggggaagagggttagaagttcacatactctcacgccattgttttcttgcgtggttctctggacaggcacctctaaacgagccaaacgcttgtcactgttgccgcatgattttgtaccggtggcttccttccatcctcccatcctccaggcaggtgggcagcgggagagagttaactatttgatgaacagtttacaaaatgagtgggcacggacaataaagcaagcctggatgctctgaaatgggccgcttggtaatcagagggcttctttccacctgcaagacttctttgcagttgaatagacacggcacagaataagcactcttatctttcttggggaaataaatgttttctcagggagctggaaaattctccctaagtataaacatttagagggggaagaaaagagataaactccctaattctagtaactaggggtaacctattggatcatatgttctcgcctccatcactgtttatgtctaaggtctgtgcagcctgaattccgcccacgttagctttcaagaaggaagaagcaatccttccattcctttccctgcttccaactcagagtgttcaaacagctggacgcctttgaaaaaaatgactgtaatcatgacaaaaacatactacttgcaacacagaactgagagagaaaagaaaaacattttctgtgatcatttttcctttgcatttctgaaaagtgagggaaattttcatttaaaaaaaaaggccataaaactgtctcaggatcccctccgcatagatgagagaagacagccatgaaaagaaattacagaatgagaaaacaacactgttctgatcctccactgcttcttttcagaagtgaatctttccagaaacttctaaacatctaataaaaaaccaaatctttttaagtcatgagtgacttttcagaaaggtgtcccatggcctcaattatatgaccaacaaaaatgaataaggtaaatccgaatggaagcaagaactcaatcaaaatgaatcagcttctttctcagctagagattcgtctaaaggattgtgttgaaccattattcttgatgattgtggactgacgtttctggaaatataagtgtcctggccaaatgggagacagagagtgtggtcagaagagttccttggagtttgtactcagttcaaatacagactgagtcatttcctaactgtgtcctcttaagcaaatcacttggcttctctaacctgagtttcctcatctacaaaacggaagtaaaaataaatacagccccgtccatcataggttctcaaaaagatgaaaagataagacaaagtgcttcaagacactaacttcttgagatggcacctggtatctcttatgcagttgttaaaagaaaacctccattattattaccatatggaggagtcacaaagatgattaactgctgctggtacacctgacttctcctcctgggtacaagaacttgaagctaaagcaaaccgatggaggttttcccatatagaagcatgtttaatgtagactcaaaaccagactgaatcatatttgcaaaatcagctaacaaacttccatcatgtcaggtcccatggggaggttcccagggatgagaagagaactaaattttgtcctcccagaactcatatgttggctactgagtgaagtaagtcagacagagaaagagaactattatatgatatgccttatatgtgaaagtttcccagtcgtgtgtgactctttgtgatcccatggactatatagtccatggaattctccaggccagaatactgaagtgggtagctgttcccttctccaggggatcttcccagcccagggactgaacccaggtctcctgtattgcagaccgattctttgccagctgagccacaggagaagcccagattcccttatagatagaatctaaaaagaaatgatacaaatgaacgtatttacaaagcagaaacagacttacagacttagagaacaaatttatggttaccaggggggaaggttggtgggaagggatagttagggagtttgggatcaatatatacacactgctgtatttcaaacggataaccaacaaggacctactgtatagcacagggaactctgctcaatgttatgtggcagcctggatgggagggtagtttgggagagaatggatacacgtatatgtacagctgagtccctttgctgtccacttgaaattcacaacattgttaattggctatactccaatacaaaataaaaatatttttaatttaaattttaaaaaattcatatgttggatgtccaaacccccaagtgattgttttaggagctaagtaaaggttatatgagttcacgaaggtggggtcctagtcaaataggattagtggccttcctagaaggtaccgcaaatggtgccccaaatgcaggcagcaaagaaaagccatgcaaggacagagcaagagggtggccatgtgcaagtgatgaagacagctcttaccaggatctgaaccagccagtatgttaatcttggacttctcagtctccagaaccaataatgaatgctgttgttcaagccacccagtctgcagtactctctgttttttatgggaattagaaataactaagagagaaagatgtcactttcttctttccccaccagcaataaattggaagtgtgccttaatgaatacagaatgcctcctttcccaaatagctctgtcctagtcttgaaggatggctggtgtatgtaaaatttataatggttttatctaattttagaagataaatacatcaaataccatattttaggtgaagtaactttcacatggggaagaaaattcacctcccactggagagctatgatgtacacaactgtcaactggagaatatattttgttgcacgatttgaaactcttggcaggactgagcaagaaagccactcccgacgacttttgtaagaaacctccttgaagcttggaggcttagttctctgctgacacacatttctgcaaccgattcacatgtctgaaaacagatgttatcatcagttatggaaattatagtttccccaagggagcgggcagtgtaccaagagatgaaaatatagatagaggatgagtaaattctaaaatgttctagtaatttctgcagaaacaagttaggtggcctccagctctactctgagcaaaatgttgcacagtcctttgaaccctcaatgggtggctggtgccagatagtggcaaagattctgggccgggagccaggaagttccagttcaaatccactagttcgatgactattcattgaggacctaatacacattatggtaaagtggaagggaacagagacaaaacaaaactaacaggtcaagtcctggccctgcccttgaccagggccaggtgaccttgggggagttggtctctcttcctgtgccttagtttaccacggttgatgggacagactaagaacagtatctgcacatcttcagaggccccatgtgtgtttgctgccatcatcactgccacttgagccagggtccatcccaggttctggccttgccaccccctttccaacacttcagagctctgtgtgactttccatgaaacatttagtctgccagtgcttcagtttcctcattcgtagattggagaaggcagtgcagatgaagtgaaataaactatgcaaaatgcatggtataaaatgattgtaaggttaatattggaaggaaatccaaaaagagaagatgtacgtacacatagagccaattaactttgctgtacagcagagactaacacaacattgtaaaataactctattccaataagcacttcccaggtggcactagggagtaaagaatccacctgccaatgcaggatatgcaagagacgcagctttgatccctgggttgggaagatcccttggagtaggaaatggcacccaactctagtattcttgcctggaaagttccatggacagaagaacctggcagcctacaatccatgaggtagaaaagagtcagacacgactgagcacaaatactgcaataaaaattaattaataaaaataaggttaatattctttttctgttcctttccacctccctcactctcccatcaccactgaattattcaccacagaccaggctacagacagaccctgataatgtccgtgggtgagggagggcattgtgattccttttgtgagctttgtctctttgatcatctgtagtcagggtcttacacacatagcacacagtggaaatagaaacaattgtctaaatcaggggtctgcaaactttttctgtaacgggccagacagtaaatatcttcggctttgtgggacacgtggtctctgtcacaactattcaacttgtggaatgtgtgaaagcaggcttagacaatctgtaaacaaatgaacacagttgtgttctaataaaactttatttacaaaaacaggcagtgggccagatttggcctgtgagctgtactttgctacccctgatctagactcatccattcaacagatactgtgttcctcatacatgaaagatactgtcccaggtgctggggatactgctgaaaatgaaataatgtccttgccccagccatatcatcaaggtatttattcttgtccatttctcacactgaggagaccaagcgaagacactttttccaaaaaggaatcatcatctgtgtaagaggctactagaagtgtgaatgaactgaggactgagaagtgaccaccagattcaataaggaagaaaccgtcgggtgacgagagcgtgtccctggaacagtggagatggaagcctgttgagtgaaatccaaggggacagaaggcaaggaagtgaggacagggcagaagtgggctgtaaacagaagcacggggcggggtggagggcatcggggacttgggcgcagggaggattttttttttctggcttgtgctgggtcttcactgcagcatgtaggcttctcattgcgatgcctgctctagtcgcagcacacgggtttagttgctctggggcatgtgggatcttagtttccagaccagggatcaaacctacatcccctgcattggaaggcagactctcaactactggaccacagggaagtcacatgttgtttcaagatgagaacctttgggcatgtttgtacagagcaagatgcaaaagtcatgtgtgactctttgtgaccccataaactgtagcccgccaggctcctctgtccatggggattctccagacaagaatacttgaagatgttgccatgccctcctccaggggatcttcccaacctagggatcacacccatgtctcctggcattggcatgtggattctttaccatctgaaccaccaggaaagccctgagggagataaaaacattcaagacagccatctcagagggtaggagaatgtgtggatcagtgacaaggaaccagcttgccaggcagcactgaggtccctccagaagagtggccagccagcagaactattgaccctcgtgagaagaatcgtcccactaggacccttgccagaccactggccagcctacagagtgtaccccttcaggttggatgtctacttctggtgccatcagtgatggccttggggcaggaatcgcaggctgctccctctgcttgactgtccatgactcttctgtgttgagtgggggttatttcccagagggatctgtagacatcaagccctagaagtgggtgagagtggataacagtctggggttaggtctgggaatatccacttggcatcatgtgactttgatttagcccatgacaatgaaatccagaagttgtacaatactcagagtgtccaagacaacactcagatcctgctctatttttttcttaattcttgcatatctgaggtgggaggcaactccagtcttgtactaccatctattctgtccttaatagtccttaatatgcaccagacattgtgcttataaccattaaaatatgttctttcaagtcatccttaaaacaatactgtggtcagaagtgctactgagtccatttcacagatgaagtatccaaagttgagtatgctcaaacgcacatggcagaacacataaccaggccaggcagacctcaaagtctgtgctctcaaccacaagcatcaactgaatatacctctcattcagttagatacgggatttgactgcaagtagcagaaactcccaaaatatcaacttaaacaaattagggttatttttctcccctcatgtaaaaaataaaattcagtggtaaatagtgcagggctggtagaagcagtacaacaccctctaagtgtgacatttctcctatctttctgtatgcctatcctcagtttgtgaacttggcactcatgatctcctcttggctacagggtggcaactccacttccagcattccatcagcattccaagcagaagaaagagatggacagaggacaaaaggtgtatgtcaatttattccctcccacttcacctttctttctgtcttttatagagtttacctggaagccccaccccacaacatctgcctacatcacattggctgcaactgtccccagccctctctggctagtccaaccctagctagtccaaccttagctgagtccaaccctaaagaaagatggtgctctgctgccacttccattgtttctccagcaaaccccctttgccagcattggtgaggcactatgaattctttaagattaaaaaaaagccatgtagttatcaccagaatgtttctataagtgtgcagtgtggttatgtcacagagaagctcttactgatcatctgtaggaaatactgaacttcttcagaatgacttactggcccccatgaggaacaaggtaccaagaacagcccaactgtcaaaattcatccactgatttcccaaagcatgccccaagggtctggatcttcacaaaggggacaggcacaactcttccaggctcacggcaccaagtctttaagagctagaagaatttccttctctttcttcttggaaagaagactcctcccctttgaaaaagagactaaggaatttatgcttgcaaggaaacaagatgctcttaaatcagttccatgtgtatctggagggttgacgctaatgtgtttaaggcttgatgataacatcttgcatttgtgtggtccctttattacaactgatgagccaatgttgatacatcattattaactgaatttcatagtttacacgagggctcattctttatccgtactttctatgtgtttggacaaatgtataatgatacgtattcaccattgtagtaccatacaaagtagtcttttcactgctctaaaaatcctcttgtgagccaactttttatctcacacttcccccagcccttgaatgccactgacctatttactatctccatagtcttcccttttcctcaatgtcacactgttgaaatcaaatagaatgtagctttttcagattggcttctttcacttagtgatacgcatttagggttcctctatgtcttgtcatggtttgatagctcctttcctctaactgcagaatactattctattgtctggatataccacattatttatccattcacctactgaaggacttcttggttgattccactttggggcaattaatgaataaagctgctataaacctacctgtgcaggttttttgtgtggacataagtttctaattccttggagtaagtattaaaaagtgctactgccagattgtatgctaagagaatgttcagttttgtaagaaactgtcaaactgacttcgcaagtggctgtaccatttcacattcccatcagcagtcaatgagtgttcattttgctccaaatcctccccagcacttgctgttgtcagtgtcttgaattttaaccccttcagtatttttaaattcattcattcaataaacacttaatgtgtacctactgagtgtcatacattagatagagtcctctcttcaggtgctcagagctcaaaatacttttagctttaaggctgaaagtttgggagagtcctgcatctttttgattaatggtttcaaagctttatctggcatctgaatcatttagagggcttgttaaaacatagattgtaatgggcaggggtaggaggcaaggcatacatccagggtgtctgattcagtaggtctgggataggacccaagaatttatatttctaacaagttcctagaggttgctgatgctattggtccaggagccacaccttgagatcactaatctagatgcttcttgatttaaagaaaaacatcacgtgagacaaccacaacctccatagtaaactctattttaagactttggggacacacctggtcccagcaaaagttcatgacatctatgcttcacctgcccctaaaagttctcaagactctctgaagcaccttagtttaaatactgttttccttccagaacagaaaacatttgataggctcatcatcactgtcaggggaagcagctctgtggtggaaaaccctagcacgaagattccttctggaacatcaagcatacattgacatcggaggctatgttaatgcatcctgataagcataaatcacagagatggaggtgggagaaagtggcaacagccgtctcgtccccctggtgctaagttttgtgctgagcccccattcgccaggtgaccccaagacctccgtcactgatggttcacatctcaaaaacagtgtcatctgcaggacagacctgactgtgaccccaggagtcagaccattctgcagccacttcttgggctctgcctttacagcctgttttaatcacagcctcgtctgcatctctgtcctaagaatcagtgtcacactcaaggtgatgctgcctccagagggaatccagttttcattgtcattctgcttgccagcatttgttgttcgtgactgtgccagacactgtgccaggcactccacatgccttctgctgaatcttcccaaaggcctccaaaggtgggtcctattggcatcaccatccccactgtgaaaacacaggctccaggccacatagctaataagtgacagaaccagaatttcaactcagctcaggctgatataacagaccgtaatgtagaagggcagatatgagccaagctactaagatatggacctagaagataggaggtagagtctagaatcaagaacagagacttccgtgaaatggatctccaactggaaatggcctttcgcctcccggttgctatggagctctgtgcatacccagggacagcccttctcttgggccacgcagaatagaattgtttacacttcatttgtctcttctgctctggagtcttgtccaaagacggcactgggaaaggtatatccttaagaaagggatggatggatgaagagtggtcaaacagcacatctagccctgaggtcttggtttctaaagctgttctccaatataagtctccagggctccttagagaagtggctgactgtaggactggagcaggaaatgtacaagatgagcctaacgtgggatgcagtaccagaaagtaatatgagcaaatagggtagggagtccctggaaaaagagaaatgggaatggatttcttgacagaagagaagccatttttgccttaagccattctgtgatctaagcttgaccacagtgcttgcccttgaacaggtctcagtagttactaattgtagaggaacaaaagaatatagaaataaaactactggtttcaggcaagagaagtaaccatagcttagataaagtatcagttgtaaagactctccagcttcccaagtggctcagtggtaaagaatccgcctgccaatgcaggaaaccgggattcaatccccatgtcaggaagatcccatggagaaggaaatggctacccgctgaagtattcttggaagtcccatgaacagaggagcctggtgggctatagtccatggggttgcaaaaacggtcggacttgactcagcaactaaataacaacaaaaactcccagttctgtttcaatgctaaatattagcctgtaggctcaaccaccagatcagctggaacttaagggatgatggtgttggccttttctgaccctcacgacttcaatccactaaagcttgaactctgtcaacaacccaagcctgttcatgaatatgcatatacccttagcttaaatggagaagggaatggctacccactccagtattcttgcctggggaatcccatggacagagaagcctggagcgctacagtccatggggttgcaaagagtcggactccactggactaacacttagcttaaaactttcccagttttctgttcagggagacactgctttgggaaagatcttcagtgttttccttacttactgaaagtaataataaatccttctttctcctgatctttggcttggttgtgttttttggctgaacaaccaccgagaggcaaactcagttttggggtaacatgggggaggaggggatcagtacaggaaaaggaaagcatttaaagttcacaatatgaatattttcccatgaaagattcatgttatagatggatcgttgctctaataattgctgtattttcctgaccatattacttcagtatagctaaatagtataagtcagtacaactatcccaaggcatacacctttccttggaaagaaccagcatggcttaatatagagcctccatcccagattcacaatccctgagcagaggaggatctctgaaagttgtggtccttttcttagaggccctagttatgtttttaacttctatcagaaccgccacactgccccaggcagccacaacaggtggatgatgccaagtaccgtggttattctatgcagtgggtaaaggtctgcacttgctttgtctgtattgatgatcatggcatatcacactcaagcaaataaacgattcagaaggaaagttgccctactgcggttggccgagaggctgggccagagttccaacaattcagtgaattccatgtttgacagcaaggagtcagtcctgccttactcccagcagagtgacgcgtccatccactcctccttcccctgtattgatcacatggaaatgaacctctgtcgattgtgttttccaggcttcctggctgaaggacagcattggaaagagactgaggagaaggaggaagggagaacccagggggccaccctctttctctctctgcttcatgggctgtctcagcagctgctgcatctccagcatgcctccagctcccaccagacacgcccaccatgggtgctgagtgactcggctcctgactctgctaacaccctccttcctgagtccccagcctaggggactgggggcctcctgctcttgctgatttttggattccttcacttcccgttgcttggcttctcagaactttcatcagctgtgtaaccaatttcctgtattaaacatcctctattttaaatagttagagtgggacttcactggttgtgcagtggttaagaacctgcctgctaatgcaaggggacacgggttcgatcctggtccgggaggatcccatatgccgcaggcagctaagcctgtgtcccacaactactgagcccataccctagagcctgctaagcctcaactactgagcccacatgctgcgactactgaagcgcgagcaccctagaccgcgtgctctgcaacaagagcagccgctgcaatgaaaaggctgtgcaccataactagagagtagctacagctcatagcaactagagaaattccacatgcagccacaaggacccagcacagccataaataaataaaacttttaataaataaatttttaaaagactcagagtagattctgatttcctgattaaactttgcaatgtctaagacctgatatttttcattttaatccagatcaagtaaaggaaacacatacattttgagatcacttttcatcagccctggacacttcatatcatttatttcataagtgtttatttgaacgaggtggatccccatcactgtgacggagtaataagaggacctgagagaagggtgcagagaaggcaatggcaccccactccggtacttttgcctggaaaatcccatggatggaggagcctggtaggctgcagtccatggggtcactaagagtcagacacgactgagcaacttcgctttcacttttcgctttcgtgcattggagaaggaaatggcaacccactccagtgttcttgcctggagaatcccagggacaggggagcctggtggctgccgtctatggggtcacacagagtcagacacgactgaagtgacttagcatagtatagaatagcatagagaagggtgcagagaagcttggctggactttatagaacctcctggccaaacaacttcagcaaaatcaatgtatctcctctaaaactaataaatttgtgggctatatactttcaagggcttctctggaggctcagacggtaaagaatccacctgcgatgcaggagacccaggttcaatccctgggtcaggaagatcccctggaggaaggcatggcaacccattccagtattcttgcctggagaatccccatggacagaggagcctggcgggctcctgagcagctaagcacagcacagcacacactttcaggactctccaaagtcacacaatgaaggaaacaacattcttctttgcttgctaggttgtccaggacaccaccttggtgtttctaggttaactagacaaactacaaagagcttccttgatggctaaaagattcctccgttcataagaagaaagatgtagttttggcctaatgttgatgttttcattttgtctcattgactccatgtggccagtccctagatgccatggtttgggatctgttagagaactagagtggttttgcagtaattaaggactatttgtttgaagagccacttgttactttgtaggggaagggttatttgtttccattgctgtctaatgcaataggccttgcctaagctaatcagactatgccaaagcctttgactgtgtggatcacaattaactgtggaatattctgaaagagatgggaataccagaccacctgatctgcctcttgagaaacctatatgcaggtcaggaagcaacagttagaactggacatggaacaatagactggttccaaataggaaaaggagtacgtcaaagctgtatactgtcaccctgcttatttaacttatatgcagagtacatcatgagaaatgctgggctggaataagcagaagctggaatcaagattgccaggagaaatatcaataacctcagatatgcagatgataccacccttatggcagaaagtgaagaggaactaaaaagcctcttgatgaaggtgaaagcagagagtgaaaaagttggcttaaagctcaacattcagaaaacgaagatcatggcatttggtcccatcacttcatgggaaatagatggggaaacagtggaaacagtggctgatgttattttttggggctccaaaatcactgcagatggtgattgcagccatgaaattaaaagacgcttactccttggaaggaaagttatgaccaacctagatagcacattcaaaagcagagacattactttgccaacaaaggtccgtctagtcaaggctatggtttttccagtggtcatgtatggatgtgagagttggactgtgaagaaagctgagcgctgaagaattgatgcttttgaactgtggtgttggagaagactcttgagagtcccttggactgcaaggagatccaaccggtccattctaaaggagatcagtcctgggtgttcattggaaggactgatgctaaagctgaaactccaatgctttggccacctcatgtgaagagttgattcactggaaaagactctgatgctgggagggattgggggcaggaggagaaggggacgacagaggatgagatggctggatgacaccaccgactcgatggacatgagtctgagtgaactctgggcgttggtaatggacaggggaggcctggcatgctgcgattcatggggtcagagtcggacatgactgagcgactgaactgaactgaactgaaaggtaaccagatagcttaaaactaaatttttcctaacataagcagtgcagataaggcttcccaggtggcacagtggtaaagaatctgcctgccaatgtaggagacacaagagatgcggtttcgacccctgggtaaggaagatctcctaggggaggaaatggcaacccactccagtattcttgcctaggaaatcccatggaccgaggagcctggcagattacaatccatgaagtcacagagagttggacacaactgagcaacttggcatagcacacacacacacaagcaattcagatcatccaaactttatcaaaaaattttcgactccctgctacattgatctaacatgagcatcctttcagcaaccaaacgtcattctagattcaggtatagtgcaaactccaaaaagcatgctttttgaggaccaagcaactcagactcttggatgattatatgtgcaaggatctgcgtatgaatacacaggcccatatcccttctatcattaagctcctgaacagtaagtttcactaaattgcttttttatcacttgaaaactgcttgcttcagaaaaatgagaaactcaacaaaacagttttattgtttttctcttgcttttatcaacatgtagcaatcacatatactgaaggacaaattctttccagaagaggcacagaaacaacttcttagaaacactgtatttggcagatggtgacctataactgagaaaggacaagatacacgccattagtcagcaaacacaagacacataaggatccctgtcttttgtggttcaaaatttcccgtcaatggacatacaagttcaaaatgaaacaaatgtcattctctttacatccccggctcacaaacttcagggtatatcaggattgcctgtgggttggcacagtgcaagtttttggctccagttctcacatatttggtagttaggagccctcaaatctaactgaaacagatccccaggttctgatgcaggaggatctcaagaacatgctttgagaaatgctgaatgaggcaccactcggaagacacagccccaattcctaaacaaaatgcatttttaccttacaatttccattttaatcgacaggtgccaccagctgttcacgcatgctcagtcactaagtcgagtcccactctttgcaatcccacggatggtagcccgccatgctcctctgtccatgggatttcccaggcaagaatactggagtgggttgccatttccttctctgcgggtcttcctgaccagggatccaacccatgtctcctgcattggcaggaggattctttaccactgtgccacctgggaagcccctgccaccagctgtgctgtagttgaattagctgatgaggacaggtgtgctaggaatcaaacaaaaccttcacttggttcatacacagagggtcctttctcttgtctgaaactcttgtggggacaccagaggtacaccgagtattttcaccccatctgctctctcccaaggggggagaggtcatttgaagagcaatccacttaccctcctcaaccggatttccttgggagactcagcaagtattattttagagcacggctctctgcccagacctggaggtcctctcctaatcagtgcctggacaaggtctgacagcctgggccaaatttggaacaggtttctgaaagccagtattggagtgtctgtgattgagacctgccaaatcgtgtgtcaggaatgtctagttccttccccgtgaagagtgacagtgtttaatgaagaaacacagctctgaaaattgagacattccctgcattgtccatattcattaaaactggaacaaagccccaggagacgcagacacctcctatcattgacacctcacattttccagtggttatttaacataaatgccatggaagctattctacaaggacataccacgtggcagcatctgccaggctgctgttccctctcttcttgtccaacctgatcctggcaggtggcaggaaggggggctgcaaattaaatgaaaactttaagaacaagattctggctgcgacatctactccacggattacccaggggataggcattttattttgctaaatgaaagggctagtttatatcttccctggatcattttctaacctaactgcagtgaaaacattctcagaaagaaagactcacttgtccacttgccctttatatcgccactggtcatcccactcggggaacttgggcagggatctgctgggtctgcttgcggaccaggccagcaaactcctccagaaggtgactgacaccagcatttcactgtatcccagtcaacccagaagccctcagcagtgtcatgtgtgagggtagatggcgttccaagcccatctttcacggagggacacgacttgtttctgtagctcctctagacaaggactcacatctaactcaagctggacaaattctacagactgggttttttgcttgctggtttgaggctttatttttgctgttaggcatctagcggttttcctctgaaagaattcatgaaaagatggtttccctatatagcacagagaactatactcagtatcctatgataaaccataatggaaaagaacacttaaaaaaagaatgtatatatatgtataactgagtcactttactgtacagcagacattaatacaacagtgtaaatcaactatgaaagtgaaagtgtgagttgctcagccatttctgaccctttgcgaccccatggactgtagcccaccaggctcctctgtccatggaattctccagacaagaatactggagtgggttgccatgcccttctccaggggatcttcctgacccagggattgaacccgggtctccagcattgcaagcagattcttaaccgtctgcaccatcaactatatttcaataaaaaatgaacaaaaaacaaaagcaaacaacaaaacaaaatgaacaaaaaataaaggtggcactccaagaaccccagggaatcccctgcgcctggttcatggtaggaacacccaagcttccttctcagaagaaaagcaagggagtgggcgtggccagtatctccctccctcccccgccccccacccgcgactccttctactttcctgcttcttcctctgacagcagctgagtggcaaaaagagaccaatcctaggaagcatttgcatcccaaccctccaacccacctgactgccagccaacttctgagctgttctgagccaccttgcctccactgataaaatcagtgtgggtaatccttcaaagggttggggaatgaatacagtgagctagggaattagaaaaagggaccgaaaggctgggtctttctgtttggtcttttttccgtgacagggggaaaagattcgagggttggaggaaactgtggttgttcatggggtccttggaaaatctcttccttgctgacacattggggtgtctctgtttcaaccacacagctgtagtgatgcgtcaggcgtgtctctgcagaaacctgcccgtctagatccaagtgcactgcacacagtgtccaggggccttccatacagcctcttagatgacgatgatgaagaaaccctttcctgcctggaggaacacggtaatgcttctcactaaaggtgatccaatgttcatatgaacattcttcgtgtgtatgttgagtgtaaatggaaaaccacctttaaaacagtcattttagagttacatagctgaggcacgactgaagcaacttagcaacagcagcagcagcagctgaggctttaaggagtcttcatgtctgaaattatacgaatgtttatgtgtactgtgaatagaatgatatttccaaagagaaaccctacagctgtacttccagtgaaaatatgtgtgtgtgtatgtgtgtgttagttgcccaatctttgcaaccccatggactgtagcccgccaagcttctctgtccatcgaattctccaggcaagaaaactggaatgggtagccatgtcctcctccaggggatcttcccaacccagggatcaaacccaggtctcctgcactgcaggctgattccttaccatctgagccacgagggtaacctaatgtgggccaaacaggtagtttaaaattttctagtaaccatgttaaataagtaattcaatcaattatattttctttaacctaataatccaatgtattatcatctgaacatgtcaccaatacaaaaaaaattgttagtgagattttacttatttctctctctctctctctctcttttttctttttacaacagttcacatccttgtgtgcgtctcggttcagactaggtctatttcaggggctttacagtcatatgtggctctcatactggacagagcatctctgtaccttttttcagcttttcacatcccattgctaacagggagcatcacaacacagcagtcaacagcaaaagattatcgctgaaaactccaaaactgaattcttggtggtcccagtaacaatttacatttctccttatgagctcaaaagggctttcagataaatgatctcatcagatcctcataacatgaacctcataacatgaacaaggaagatgtcatttcctcatattacagctgagaaaactaaagccttaaaaatattgaataattggccaaaactcaaagagctagaggttggtgagttaggaacttgaactgactcttgggattttaaatccctaggtctggctgagaaggaggcagccgcctccctctgtcatcacacttctgtggaagggacgtctgtttgcatccccggcctaaacataaagtccaagaaggcaggaactgatagaccctatgcacagtgcctggcatgaagcagagacacagatcatatacctgaattaaatccaactgaaccaaaagagtcatccacaccagacccctcatagacatcgcccaaatcaccccatctctgagaatttttgtggagccccagctacaaaaaccacctacatgctaaggtcctgaattgactttgttcaccctttgatgcccctttatttcccaacacacaaaacagggggattttttttttctgggcttcatgtggctctgttttaattctcactttgtacttttaaatgggaatttacatctctagtggaaaatacaccttgaaagtagattcaaagttccttaaaaaactaaaaatagaaagaactaccatatgactcagcaatcccagccctgggtatatacccagagaaaactgtacctcagaaagacgcatgctcccaatgttaactgcagcactattaacaacagccaagacatggaagcaatctgcttgtcggttgacagaggaatggataaagatgtggcacatatatacaatggaatattactcagccataaaaagaaataatgccacttgcagcaacatggatagctctaacgactaccacactaaatgacataagtttggaaaagacaaatatcatatgataccatttatatgtggaatctaaaaaaattatacaaatgaactgatttatgaaacagaaacagacacagattttgcaaacaagtttaggattaccaaagaagaaaggttggagggagggataaattagaaggttgggattaacatatacacacatataaaaaaacatatacacacatatatacacatataaaaaagataaccaacaagaacctattgtatagcacagagaactctactcaattccctgtaatgacatatatgggaaaagaattcgaaaacgaattgacatatgtatatgtataactgaagcactttgctgtacatctgaaactaacacaaaattgtaaatacacttcaatagaatttttttttaattttaaaagaaaggagattaagtctgacttgtgctttggatgccaatctctacccacccaagaccacctggaggagcccagcgaccacccgtgagcctggtgaggcacagcacaagggaaacacctcactgcccctccacactgccagctgagctgggctgaatcatacacattcaggagagtggtaaaacccctgacaagcactgtcagaggatagcttgaaaccttggtggagacatgaatctgttcccagcagcctccagcacagtctccggctggcccctggctcccttctctgcctctgtcagcaccagccccctccactgaaggtcccttgcctgcctgtgcagcaccctggcattttgggtggctgtgccagggtttcatggagaccctgggccaggtgctgagagctgctatcttccccgaggtgttaggatgtcagaaagtggcagagatccaggtctgaccctgtctgccccacgccttcgtcagctgcttcttgccaccttgccactgggcatgagagaggaacttagaggaggaggttacaagcaaaagcttattctgaactttgtgtgagctccttaagtcagacaggcaagcattccatagctcaggacctcacatgcgcccctacaaatgcaaactgtgatccaactgaatcccatactatttctgtcaaatgagtcttatttttgtaatgcttctccatgaactagtttctctggaaaacacccaaaaccatgttcacattttgtttgaaataatattttaaaagctttgttaaaagagcaaaccgagcgaagtgcactgaaagagctgtgattaattccatcaatatctgagtacctgttgtttctgaacgtcaaagttttagacactagagagaccgaggtgattaaaccacagagtctcttgtgaaggttataatctagtgggcgagggcagacaaaaaaataagaaaacaaatcaatgagatcactgttataatcactgttataatggttatacagccaatgaagagcacagaacagggtaatggggcataggaccacgctgggatggggaagaccacttagaacggtggtctgagaaaagctttcagagaacttgacactcaggttgtggaatgaacgactagggacagatagccacatgaagatctggggaggagtgtgttacacagaaggaatagccaaggcaggagtgagcttggagccttgggagaggccaatgtggccagagtggggtgagcaatggagaaaacggtgaagaatgatgttggggctcactgggggccccatgatgacaagtatggattctactataagcagcaagcaaagtcattggaaggcaccacagtggagcaatgcaagcgcagtcaggcttcctaagacccatcccagctgccactggggatggatggtggaaggggccagaaggagagcagagagcggggggggccaagcccaagatggcagggagagcacagcatgagttgacccccctactgatgtgaatgtttgtttctgcatgacattagtctgctatcaaataatcattctcattctctccatccccacagagggcacaattagtatcttctagaggctgatggaaacagtgacagactttattttcttgggctccaaaatcactgtggatggtgactgcagccatgaaattagaacatgcttgctccttggcagaaaagcaatggcaaacctagacggcatattaaaaagcagacacattactttgctgacaaagacccatatagtcaaagctatggtttttccagtagctgagcaccaagtaattgatgcctttgaattgtggtgctggagaagactcttgagagtcccttggacagcaaaaagatcaagccagtcaatcctaaaggaaatcaaccctgaatattcatcaaaaggactgaggctgaagccaaaactccagtactttgcccacctgatgggaagagctgattcactggaaaagaccctgatgttgtgaaagattgaaagcaggaggagaaggggacgacagaggatgagatggttggatggcatcaccaacctgatggacatgagtttcagcaaagtccaggagttggtgaaggacagggaagcctggtgtgctgcagtccatgaggtctcaaagagccaacacgactgagcgactgaacaacaacaacaatggttaccctgagctgataccctcgtcatggggtagagagtcaatctttccataggaacagtacagtcgcttccatgtgagtaagagcaacagaaaggcatctttgtctttctttgatgtggggaattcataagatgctggaagccacaaagggcatggccttatttcctgattagatactaagacacatcctgggtggagctcactttggtgagactgagaccctgtctgcagggatcagactgtgacacttgctctccacggtcccctggattttcagcttaccaatcaattcaccctgaagattctgcacttcccagccttcataatcacatgagccaagtctttataatgaatctttaaaaagttctttacaataaatataaatatatacacatataaatcatataagatttagataaatcttatgctacataagatgtatacatgtttcctataaaatagtgtgttagtcgctcagtcgtgtctcactctttgtgacccccatggactgtagcctgccaggatcctctattcactggaatttcacaggcaataatgcaggagtggcatgtttatactttatcttaacttatataaatcttatacttccttaatatgtatataattatatgtacatatatatgtatacaatgataatgtatataattaaatatataataggatagtgtatatatcctttctctggcctgacaaatagagcatggttgaagagtatcctcctaaggttcccattcctgctgcaatggagaagtcacacaatccattacctgtctcgttcagagtgagctgaatggagataggaaaccccaaatctaggaaacaaaagaaaaaccagggacagcagccagtgtcattctaggaggataaagtaggaaaaacggtttgagttctgctctttcctccaattgccttggaatcaatagctgctctcccccttcagaaattaatagtaatagcccagactgctggtctaggagcaaaaaaaaagaaaaaacagctcaaaagtcctgttcctgtgaagcgtttctgaacacaagtgaaagctgagtagactctgcattccctgctctcccaacccagggctgggatgatcatctctgagttcctctagccagggctgcctctacctcagacactgaaggggaagactggggctcaagaattgcttggtggattataccaaatatgagtgtcctatgtggggctttctcttggacttcccccttttctttccttgttcatgagaacaaaacaataaaaaaaaaaatagggggaaatataaggtatgaaaattaaataacgggaataaataacacagtaagtcttctacgtggttaaatggatacagctggagaatgaattagtgagttggaatatcagatgagatgtctccagaaagaaaatagggttcagaaatagaaaatataaaagaatagttaagaaagttgtagaagcaccagtatccagaaaacaggagtcatggaatagaagaaaaaataaaataaaaatggagaaaagaaaatatttgaggaatcaatggagataaagtcctcagaattaaggaagacaaataacttcaaactgaaagggtatatagaattccaaaaggagagagaaggaaaatccaacacttacacacactagaatgaaatttaagaaaaaccacactcaaagaaatggagaaggcaatggcaccccattccagtgctcttgcctggagaatcccatggacggaggagcctggtgggctgcagtccatggggttgctaagagtcagacacggctgaacgacttcattttcacttttcactttcatgcattggagaaggaaatggcaacccactccagtgttcttgcctggagaatcccagggacgggagcctggtgggctgccgtctatggggtcgcacagagtcggacacgactgaagcgacttagcagcagcactcaaagaaaaaaatctgaaaactctccaaaagagcacatcaactgcaaatgaaaaagaataaaatggacatcacattttttaaacacaatgttaaatgagaaaagataacagagtatcagttttaaagcattggaaaagatgctttgaactagaattccattcccatcaaggttgtcattcaaatataagaatgtaataaaaatattatctaacatacaggcttgaggaaatctgccatactaagagtcacattaaaactttttgaagatattatactcaggaaaaacacatccaaaagaaactgcaagaagtatgtgaaagaaaagggatcatacatcttggaatttttgttgttgtggatattaatatggagaaaatgttcaaaggatatgaaagcatgtttaagctatataaaagatacagatatgaaaatgtctaaataacagaagcagaaatcttctattttaaatctttttactaaacttaaaatgaagacaaatacatcaaaaaaataaataaatataaatggtctaaatattccaattaaaaaacaaatttttagatcagattttaaaaacaaaattcacatatgtactatttgtgagatatatctaaagcattaaaacatgaaaaagttaaaaattaaataatttttaaaaggtagcagacatatattagataaaacatacttcaagacaaaaggcataattaggacttgaggatcactcagtagtgatgaaagagttctccaagaagacacagcaattcaaaatatgattgcatctaattaactagcttcaaaatataaagagaaagaatagaaattcaagggaaaatgggcaaatccacttcatcatggagatttcaactatttgataggtctcaattatttaaaagttgggcagataaaagtcaacaacacaattaacaaacttgacctaataaccacaaacagaattctgtacccaataattagaaaatgcacagccttctcacacatgcatgaaatacttttttaaaaatcttccaataatcaatgaaggattcagctgagttcatagaaactcaggaaaaaacaacatttcctagcttcactacatatggtcacatgactaacagcaagtgggatatgacagaagtgaactatgtgacttccccacgagacccttaaatggcatcctactgcctggctcaagaaacaaccaagaggtatcttagatcatgcaaagggagccaagcaataagacagaaggatcatgggttcccagatactgagggctgctaggctgcttatactggggagattttgcgagaaagaacattcgatcaagttgaaatctcctcttgcagtggaatgaggtccttcccgttttgtctacctcaggacacagaatatgtgttggaactggcacatctaaagcaaagcacaccaaattcactccagaaagagaagacactgataagcacggtagacaggaaaccagtctttgccttgcagcaaaagcttagatgccagtggagattttgaagggggatctccatatgagatcagaatctttcaccagtcagttctaggacaccatcaaataagcagggcccggtgagaggagtcctgcccaccctcattcccacagaggggaagtgaagtgaagtgaagtcgctcagtcacgtccgactctttgtgacaccgtggactctagcccaccaggctcctccgtccatgggattctccaggcaagaatactggagtagtttgccagttccttctccaacagaggggaagggcagagaaataaagaggaaccaagggagaaaacacgtgaaggaagtgacagtgactggtatgggaggccagccattacaaggcaggctcgttctgccaaaaccatatttgttttgaggttggattggaggaaggagcgctcctttgtaaaaaaataaaataaaataaaatagtttctgaatgcaacaggaaaactgggaggcgggtggtaagcataggccatggtgaaaaaataaacgccttcatcacaaattgctgaagatgggtgaacacaagactgaagagaactgaagatggcgaatgactctgaggaaaaaactctctgtggtgacgtcgacagccttggagtcacgtgataggggacagctcaagcttaaagtccgggcagagaaccccagccctctccgcagtcacggggacggtcgtaccaggaactctagaaacacagatcaactcatgaggttgaaaagtagccatctttgatggttgtgctgtcttttctttccaaggatttccttagctggctaacatgtagcacccaccaccggaaaggggtgaggctggagataagcctgcttccagattcaggggtggggcatgcgcagcaaaatcccagcagctggaggcatcttaagtgccttctctcccttctggaagcccttcctaccacctagaccttttctaccttgtccccttcttcctcaccccaacacaccaaaccccttccagaacattctttcagagccctcttctgaacccccacactccacaccataaagccactggaatcctatggtgtgtctgagaaggcagccatggaaagtccagagcagcactacctccccagggctatttacgatttaaaatagaaccctatagaacacctcttgagagtcccttggacaacaaggagatccaacctgttcatcctaaaggaaattcattggaaggactgatgctgaagctgaaactccagtcctttggccacctgatgcgaagaactgactcactggaaaagaccctgatgctgggaaagattgaaggcaggaggagaaggggacaacagagaatgagatggttggatggcatcaccaacttgatggacatgagtttgggtagactccaggagttggtgatggacagggaagcctggcatgctgcagtccatggggtcacaaagtgttggacacttagagtcactaagtcagacttagtaactgaactgaactgaactgataaaacacccgtgggtgcacacgggccaagtcacctcagtcgtgtcagactctgtgtgaccctatggactgtagcctgccaggctcctctgtccatgggatgctacaggccagaatactggagcaggttgccatttcctcctctggaggatgttccccaaccaggggtccaacccaagtctcctgcattggcagacgggttcttttaccactagcgccacctgagaagtcccatagaacacccgtgagcctccaagtcggtacctcaacgttgatgaggtgtctgaatccaggtgaggtatctgaatccctgtggagctttacaaaatatagattttggacggccactcctcatctgggtaaacagaatatccagaaaaggcggtgaggtgggaatgtgcagttttcagtcatttgcctaagggattctgatgtctgccaaggctgagagccagggctgggggcagtatcaaacagattttgatactttgtagctccagctttattgactcacaggtctagaaggttaaagagattgaagatgtaccaagacctacagagagacttccaactgttgttcttgcctattaagggccttaattggcttgctaatagacattctctgtttaaggacatgatcctgaacacagacgttatcaacttcaaatgtcattttcgtcgagttattcgttgaactcgattgtgatcccccatcatgtcttcaattaaattaaaaccagatttcccacggaggctctccatatggccctcccctgcttaaaaagcttcttcttgtgtccgtgtcccctaattgagttcttctattccctcttcccggaatcttctcctccctgtcgtaccacaacctctccttcatcctttaggatggacacctacacctccatcttccctttctaggaagccttctacatctttttcagcaaggtttgcatcttcttcctccaagcctgcctctaccagagctcagatatattgtcccgggatatctacacctccctcctcccaaactttgaactctacaagtgctggaaatggggcttgatcatcactgtgtccccagtgtcttgcacaaagcctgtgtgtagtaaacggtcaataataaatgctggaggaattaaatgaaagtacaaatgaaaaaaagcccacttgaagctcatgtaaacaatgctcactctcttccatcttcctcaaaatttcattcttttggcatgaaacaacctgaaaaccgcacgcctaccatgagggcagtgatggtgtctcctctattctcccctgtctgccctgtgcctaggaccaggcttggctactgtagatgctaaagagctctctgttaactaggagtcagtccttcaaactgattgctctaaatccacctcctgtacccaactcaccccacccctcccagcactgtccccaccagcacccgcctcttgttgccacatcttcatggtgtgactgagtcaaacaaacccatgcctgagtaaactgaacatttcaggagcttccttccccaaagcagatatgatctgatgatccactcaccactcaagcaaagacaaaagtgtcagaatgaaaagccaccttttgtaaatctccatccatcctgccattctgtctccatctagaattatggtacaaatatactgatttggagctcagggaaaattttttccaaggtgatgcaatccagaaattgattatgtactcattttcccctaggtacaaaagagggaaaaaagagtctgttgtgcagattttataggtaactattagttattattaatagtcaggtaactatgtgagtaggtagaagaatagagtattctgctccattaaacatggtagaggattgaaaattgctgtttacatcattcattccctaagtttccaagaattagaacataatgaaatacacttcccagttaaaacctattgaacatgagccgatctttcgtcatttttacaaaaggtacagaagtcctgtggttaaaggacccacttgaaagggtgctgtgtgcgttggctgggcacacgctgccccttccacatgcactggatctgtctgtgccttggcgctcaccctgtaacagcttcacatcaataaactccagtgactccttgtactggcctgtttgctaatgaaatcagccactgacctcccctctggctcttgcgctcccaggcttcatcttcttgcatactctaatgggaagctcagttgttttacttcatactactttttcagttttcacctcctgacatttatatttcttaaggttagtgctacaaaggactttgggtacacccaacaagccataaacagtgctagagggccacgtaccacaggataaaacagcaagaaaaaccttatgctttgagcttagcataatactttttattaaaacacctgcattttgatggctgtcactgtgaggtaaggaagatgagttcaccaccggagacactggtgaaaaatctggaagactgatctaatgagaccttgtcgttaagcctggagtccataacagatgagtcactgcatggctctgctgatatttctaataataacatcaataatgataataataatggctactattttatgaggtaggtattattattccccttttacaggagagaaaactgaggcttaaactgtaaaaagccaggatcgagagctcataactgagggtgctgatactctgacccatctgtgtgatgctaaagctcattctcttcgctactctaatgagaggtcaatgccatccccgtcttgtgcgtgtgtgtgtgcacccacacgtcccatcattagagagagtctgtgattattttggttacccagcatccctgcgtttcggggatccttcatcctgtggatgcatctggtgggaggcaaggtcaagaatgtccttgtacagaagctgaacacgtgaactactcccattcctgctaaagttgccattaggactcaagcacatagcccaggctcagcccatccaggatctgactcaggagtgatgatggggagaagaagggaccacaggaagccatcccagtgaagccgcagaggcctccacgccacagggccaagggccagtgctcaaggtgtccgtgtggggacctggttacggtcttggcttccttctgtcctgtctgccgtcttctgttttgctttatgagcttggcttgccatcagagtgggtacacaaaccaagaccaagcatctcaacgctgagggtatcaatgccaaccaagtatttcatgaggatgcctgagggtggagaagggctgaacagtcagcgagcccctccagcccccaccccatgactccttaactccacacgtggccaaaagtgggaatagagctggacagcctttccaagcaggacaactcctttaatagtctgctcgggctgccatagactggacaggctaaacaacagagctttactgtccctcagctctggaggctgcaagtccaagatcaaggtgccgggagggttggtttgcagatgtgtcccacattttctggctgtgttctcatacggtcattcctctgtgcctttttgtgtcctatctcctcttttcataggacacaagtctgattggattagcaccctttatggccttattttaacttaatcacctttaaagtcctccatctccaaatatagttacattctgagctactgggcctccttagggcctccacataaagatttggacagggaacacaattcagtccatcgcagtgtcaaataatttcgtttgtcttcattacacttttgtgtttgtgcattagacgtaagagacgcaggttcgatccctgggttgggaagatctcctggaggagggcatggcaacccactccagtattctcacctggagaatcctttggacagaggagcctggagggctagagttcatactgtcgcaaagaactgggcacgactaaagcaacttagcacacagattgtaacccaccaggctcccctgttcagttgtgtctgactctttgcaacaccatggactgtagccccaccaggctcctccatccatgggattctccaggcaagagtaccggagtgggttgccatttcctcctccaagggggtcttccccacccacagatcacacccacatctcttaagtctcctgcactggcaggcaggttctttaccactagcaccaccttggaagcccatctattgaatgggggtatgttaataaaacattgaaattggggtttcattcatcacagcatcaccgagatttgaaatctggatttgagaaagtgggagacacattagtctttagacaacaacaacggggcacagtctgggtcagcccctcacaatgtcttcacatcccagggtctgatacccagtggctgggacctggtgtccagtcagggtgatggtccaaaatcctcgctggctgctgcagcaaggaggcttcccagagaggaacagcaccccgtcccagcctgcctgtctggccgtcctgtgtcatgtcccagcttcttactgatcacttggagcctgtaggcgtggactctgtgctctcagccccacgtccaccttgaggtcaccagctgcttgcagccagactctgtcctgctccctgaaggtgtcacacaacagaaacactcacctgtcaccaggctgggtcctcatccaccaaagtgtttacctgccaagtgagcctgcatttaagtggaaagaagtgattaccaaaagggttttgctttcaacttaggctaaacagcacctgtgggacttcccttgtggtccagtggtggagacgccacactgccaatccaggtagcatggatttgatcccacactaagatcccacatgctgtgcaacactgccagaagattaaaaaaaaaatttttttatccactgtttaaataaaatgtgttcaaaagagattgaggggagaactggtgtgtccttagctgaattagttacccattaccacagccttgtctttcttctttgttttaaagtgaaagtgaaagtgtactctgattcctggactgtagcccaccaggctcctccatccatgggattctctaggcgagaatactggagtgggttgccatttccttctccaggggatcttcccaacccagggattgaacccaggtctcccaccttgcaggcagatgctttaacctctgacccaccagggaagccctttgttttaaatgtaatccacaaagcctctcctccaagcttggacagtagacaccatcttttcccccagaaaaatgactcctgggagaactgcagaccttccagggaactctgatgctcttagcaacaccctccccaccccctcccttctccttttgcagatcgagcagcctccatggagggtcttctccaaggatagcttcctctctgaaagagctgcctctaacccagaggccatgtcaggctgggaaaggagacttgggctggatttctgaagagaggagcttcttctcactcgaggcttactgactcggggaccttgggcaagtcatggtagactcttttccccagctctaaaaatggcaacaacaggatggcccagccaacccaggaagctctttgaggaagcagacaagataacacaccagtgagtgtctgggagccacacagagctctttaaacacttgtcccttccccttttctgcctgccaaggtcccacccatcctgtaaggcccatctttgcctgcaggtggggggcagtgggaggcctggggcctgagattttgctgtgggaatgatcctagagactagagccagcatgacctgcaggcacagctgcaggtcacttgcctccaaggactagagagacgtctgtgggaatcctgcctcggacgtgctatgatttagagggggttgagacatggggcagcagagggtgtcctcacagagccccaaatccagagtggactcagtctagcttggcgtcatcttcagattgacttgcattaactgacactcacccaggctaccaagagaatcttgtcgagagaggattgcttagaggagaactggttctgttggcctcaaagactggctttgagccccaacagagagaaagctacaagagtttctatttttgaataaatggtgtaaacgggtgacagtgggtcttttagtctctttggactgctgtaacaaaataccacaggtggggcggcttagaaacgacagaatttcttttctaacagttgtggaagtggaagtccaagctcggagtgctcgtgtggtcaggtgagggctctcttctgggttacagacttctcactgtgtgctcacgcagtagaagggctggcgagccctccagggtctctgctgtaaggccattaatcccatttgtgagggctccacccttatggtctaatcacctcttgacaccatcacattgaacactaagatttcaacataagaatttggagggtggcacaacaaacaccctcttccaacaacacaagagaagactctacacatggacgtcaccagatggtcaacaccgaaatcagattggttatactctttgcactcaaagatggagaagctttatacagtcagcaaaaacaagaccgggagctgactgtggctcagctcatgagctccttattgccaaattgaagaaagtagggaaaaacactagaccattcaggtatgacctaaatcaaatcccttatgattatacagtggaagttggaaaaagatacaagggactagatctgatacatagagtgcctgatgaactatggaagaaggtttgtgacactgtacaggagacagggatcaagaccatccccatggaaaagaaatgcaaaaaatgcaaaatggctatctggggaggccttacaaatagctgtgaaaagaagagaagtgaaaagcaaaggagaaaaggaaagatataagcatcttaatacagagttccaaagaatagcaagaagagataagaaagccttcctcaatgatcaatgcaaagaaatagaggaaaacaacagaatgggaaagactagagatctcttcaagaaaatcagagataccaagagaacatttcatgcaaagatgggctcgataaaggacagaaatggtatggaccttaacagaagcagaagatattaagaagaggtggcaagaatacacagaagaactgtacaaaaaagatcttcatgaccaagataatcacgatggtatgatcactcacctagagccagacatcctggaatgtgaagtcaagtggtcctcaggaagcatcactatgaacaaagctagtgaaggtgatggaattccagttgagctatttcaaatcctgatagatgatgctgtgaaagtgctgcactcaatatgccagcaaatttggaaaactcagcagtggccacaggactggaaaaggtcagttttcattccaatcccaaagaaaggcaatgccaaagaatgctcaaactaccacacaattgaactcatctcacatactagcaaagtaatgctcaaaattctccaagccaggcttcagcaatatgtgaactgtgaacttcctgatgttcaagctggttttagaaaaggcagaggaaccagagatcaaattgccaacatctgctggatcattgaaaaagcaagagttccagaaaaacatctatttctgctttattaactatgccaaagcctttgactgtgtggatcacaataaactgtagaaacttctgaaagaggtgggaataccagaccacttgacctgcctcttgagaaatctatatgcaggtcaggaaggaacagttagaactggacatggaacaacagactggttccaaataggaaaaggagtacgtcaaggctgtatattgtcaccctgcttatttaacttatatgcagagtacatcatgaaaaatgctggactggaagaagcacaagttggaatcaagattgccgggcgaaatatcaataaccttagatatgcagatgacaccacccttatagcagaaagtgaagaggaactaaaaagcctcttgatgaaagtgaaaaaggagagtgaaaaagttggcttaaagctcaacattcagaaaatgaagatcatggcatattgtcccatcacttcatgggaaatagatggggaaacagtggaaacagtgtcagactttatttttgggggctccaaaatcactgcagatggtgactgcagccatgaaattaaaagacacttactcctcggaaggaaagttatgaccaacctagatagcatattcaaaagcagagacattactctgccaacaaaggtccatctagtcaaggctatggtttttcctgtggtcatgtatggatgtgagagttggactgtgaagaaagctgagcgctgaagaattgatgcttttgaactgtggtgttggagaagactcttgtgagtctcttggactgtaaggagatccagccagtccattctgaaggagatcagccctgggtgttcattggaaggaatgatgctaaagctgaaactccagtactttggccacctcatgtgaagagttgactcattggaaaagactctgatgctgggagggattgggggcaggaggaaaagggaatgacagaggatgagatggctggatggcatcactgactcgatggacatgagtctgagtaaactccgggagttggtgatggacagggaggcctggcgtgctgcaattcatggggtcacaaagagacacgactgagtgactgaactgaactgaactgaacaaacattcattctccaactgaatgcagagttccagagaataacaatgagaaataagaaggccctgatagcttaatggtaaagtatctgcctgccaatgcaggagacgtgggttcgatccctgagttgggacgatcccatggagtaggaaatggcaacccactccagtattcttgcctggaaaattccgcggacagaggagcctggtgggctacagtccatgggatcacgaagagttggacatgactgaacaaatactcttgctgcaaagtgtctggctgccactcttacatgaacattttaaagaggtttaagaaaacaacagagtagaagggacaagggatctcttcaggagaactggagatgttaagggaacatttcatgcaaggataggcgtgataaaggacagaaacagtaaggacctaacagaagcataagatatcaagaagaggtggcaagaatacaaagaatacacagaagaactatacagaaaaaggtcttaataacctggataaccatgatagtatggtcactcacctagagcagacatcctggagtatgaagtcaagtgggccttaggaagcattactaataaactagtggaggtgatagaattccagctgagctatttcaaatcctaaaagatgatgctgttaaagtgatgcacttaatatgccagcaaatttggaaaactaagcaatgaccacaggactggaaaaagtcagttttcatcccaatcccaaacaaggacaaagccaaagaatgttcaaactactgtacatttgcactcatttcacatgccagtaaggaaatccttaaagctggcttcagcagtacatggaccaagaacttttagatgtgcaagctaggtttagaaaaagcagaggaaccagagatcaaatcccttggattatagataaagcaagggaattccagaaaaacatccacttctgcttcattgactacactaaagcctttgactgtatggatcacaacaagctgtgagaaattcttgaagagatgagaataccaaactgtctcacctgtctcctgagaaaactgtatgtaggacaagaagcaacagttagaactggacgtggaacaattaagtggttcaaaactggaaaaggagtatggcaaggttgtacattgccaccttgcttagttaacttaaatgcagagtacatcatgcaaaatgccaggctggatgaatcacaaactggaatcaagatttccaggagaaatatcaacaacttcagatatgcagatgatacaactctaatggcagaaagtgaagaggaactaaagagcctcttgatgagggtgaaaaaggagagtgaaaaagctggcttggaactcaacagtaaagaaactaagatcatggcatctggtctcatcactttatgacaaatacaagggggaaaagtgaaagcagtgaaaatttttattttcttgggctccaaaatcactgcagatggtgactgcagatatgaaattaaagacactctctccttggaaggaaagttatgacaaatctagacaactagaagcagagacagcactttgccaacaaaggtccatatagtcaaagctgtgttttttccagtagtcatgtatagatgtgcgagctggaccacaaaaaaggctgagcaccaaagaattgatgcttttgaactgtggtgttggagaagactcttgagagtcccttggactacaagggggtcaaaccagtcaatcctcaagaaaatcaactctgaatatgcattggaaggactgatgatgaagctgaagctccaatcatttggccacctgatgcgaagaactgactcatttgaaaagaccctaatgctgggaaagattgaaggcaggaggaggaaggggcacagaggatgagatggttagatagcatcactgatttgagcaaaatctgggagatagtgaaggacaaaggagcctggcgtgttgcagttcgtgaggtcacaaagagttggaaatgatttagcgactgaacattaacaaacaaagattaaggaaaagtaagagagttagatgtggtgtgatgtcaggagtgtgtctgtagtatggggatgtgtatgaggggtgtattgggtgtgtgtgttggagggggtgctggtacgtgatgtatgtgtgtgtgaggtgtgtgtttggtgtgggggtggtattgggtgtgtggtgcgatgtacgtgtggtgtgtgcatatgtgtgtctggtgttggtatatgagtggtgtggtgtggggagttggtatgtttgtggcatgatgtgatgtgtgtgtagaggatattaggtatgtgaggtgtgatgtatgtgtgtaggggtgtgtgtgtggtatgatgtgtgtgtaaagggtgtgtgtgtggtgtgatgtgtgtataggggtgtgtgtgtggtgtgatgtgtgtgtagagggtgtgtgtgtggtatgatgtgtgtgtaaggggtatgtgtgtggtgtgatgtgtgtgtagggggtgtgtgtgtggtgtgatgtgtgtgtgtaggggtgtgtgtatagtgtgatgtgtgtgtgtagggtatatgtgtggtgtgatgtgtgtgtaggggtgtgtgtgtggtgtgatgtgtgtgtgtggtgtgatgtgtgtgtagtgtgatgtatgtgtagggatgtgtgtggtgtgatgtgggtgtgtaggggtgtgtgtggtgtgatgtgtgtgtagtggtgtgtgtgtggtgtgatgtgtatgtagtgtgatgtatgtgtaggggtatgtgtggtgtgatgtgggtgtgtaggggtgtgtgtggtgtgatgtgtgtgtagtggtgtgtgtgtggtgtgatgtttgtggtgtgatgtgtggtgtgattgtgtgtggtgtgatgtgtgtgtggtgtgatgtgtgtggtgtggtgtgatgtgtgtggtgtgatgtgtgtgtgtggtgtgatgtgtgtgtagggtgtgttctaggggagcagcagcagggaggcgccctggtaccaggtcgagctgggaggaaccacaggctcccctccagcccctcctcctgtgcaccccttcccccagggccacaggctccttctcttcctcttcccatcagcccagcgcagggaagggaagagggagcaggaagacacaccagtccttccaaggtgcccctccatttcttcctcctctcctcctgcccctgagaccctgtgcccagcctcagcctggagaacagaggtgagtggacactttcttagtaagcagttcacttctgggccctgcagcacaaaacagacctctgtcttctttggctggaaaaaaacgttggcaagacaaaagcacacacacacagtaaaagcaaagatgccactgacccttccactgttgatgtccctcgcttccccagatgcgttatctccaaatataaagtactgtgcgcgccaggcctccggcacagcgtgggagacagaaacagactcacggggacaggaagcgcacacaccggggggccgtgagtgacactggcgacgtgtccgctgcctgtggaatcagtcctgagtcccgcacagacgccccccaccccccgggaggtgaggccaaggccaaaagccaggcctggaggctgagtcctgaacacacagccgggctctcaccagagccgcggagcaggggcccgcgaaaattatgcgccctcatgtgcccagtggggcggctcatgcgcctgcatatcttggaccttccccggccggtggggatggcttgccggagtgacgggggtgcggcagggccgggggcaactttgttttttgcaaacatcgtttcccgtaaatagcttggttagaactaaaaaccaaagtggaatgcatccaggctccagaaacactctcctgctgcattccctgggctgagaccattctctcctccgacatatggcctcctcaaacttcctcctgcagctgcttccagccaggcctcccttcacttccaaaatgttcttcaaaggacatcccagcaggaacatacagcaggctgtttggtcattcaaggaaaaaaaagccttggtcagagatggctccaaggacttcactggcggtccagtggttcagactccacgcttccaatggagggggcacaggttggatccctggtccgggaactaagatcctacaaggccatttggtgcagccaaaaagagaaaaagacatggctccaatccatccaggaaattaaaagtctgccgtgtgaaaggattcttctcatcgactccctcatggtgccctgggggcatagttccatgggggttttaccccaaaaataagagaagtggagaggtgacaggttcacactgtcagaccaagggatcctttgaccccacattcttcgcatccctctagaacactgagcataaataatacatttacctacgtaactcaacccatttggttgtatatcaaggttattgtgagttccatgtgagttattgtgagttcatggtgtgtgtctggatctaaactgagatgccttgggagggaggtgggagtggggttcaggatgggaaacacatgtacacccatggctgattcatgtcaatgtatggcaaaaaccactacaatattgtaattagcctcaaattaaaataaataagtaaatttaaataaaattttttaaaaatttaataaagtaaaaagtaaataaataaactgaaatgccttttctgctcccctaagagacagtagaatgttctctgaggatcaaagagctgtaagagccagctcatggcgcactggaagaataaggggctggagaataagggcaggagaagaaagggttcaggacaagaggtagcctgaaggggccagcagacccattacagcagagtaaggagttgtcaggagatttgaactgggagtgaacaggtcccctaagcttgactcttcagccagcagggccaggcagccaggaagagggacttgattaagatcaagtccaagaccaggggaccatcccatgctgacaggcctgtcctctgcccccatgagtactgcagaggttctagtcagctgacccatatcctcattctagggtcagctctctggttctggaagatctgcatgaatgatggccatgagtgacctaccaggagaggtccccgaggggaccagagtgggggtaccactggctacccccagggcctccaatcatgcaggaaagacagagaaaaacaagcagctggcttgttcaggaggcattattgcgtttaacaaaccaggtgttcagacattatctgggagaaaccgaaatccttatacatgctgatggaagtgcaaaatggtgcagccactatgaagaacaatctggcagttccaccacaaatcaaacatatatatatgccagccgctcagtcctgtccaactcttcgtggccccaaggactgtaccttgccagactcctctatccatgggattttccaggcaagaatattggagtggttgccatttcctcttccaggggatcttcccggcccagggatcgaacccgtgtctcttgtgtctcctgcattggcaggcgggttctttaccacgagcgctacctgggaggccgccaaagaaggatgcctaccagcactgtttctgcccttaggagaagccccggtgacccaacaattccgctcctaggtatgtacccaaaagaacttgaaagcaagtgttccagcaaaaatgtatatagcaatgtttgtaggagcagtactcataagagccaaaaggcagaacaatccaaaggtccatcagcgaatgaacagataagcaaaaagctgcgtatttacacaatggagtattattcagacatacaaaatgaaacacacatgctacagcatgagtgagtcttggaaccattatgctacgtaaaaaacccagacacaaaaggccatatgttgggtgcatccatgtaaaggaaatgtccagaataggtaaatccatagatacagaaagcagatttgtgattgccaggggcagggggtggggctgagcagaaacagtgagttactgcttggcagaaacaaggcttctgtttgggatgatgaaatattctggaactagaatgtacttaaggccactgcattgtacactttgaaatggttaaaaaggtaaagtttctgttatgtctattttactacaactggagaggaaaagggaggctggaggaaaaacaagttatctggcaatttttcgagttcgcaaaatttgatttattggaaagaaacttgatccactacagatgagatgctaagtgtcaggcttttagtcatgctatgatgtcaggtttgcttcatctggaaacaacactttgcgaagtgcgtgctgcgtccagggctcagatttctgctcatcctcatggtgacaccgagagaggagagatggggccgtggtcacttccttcctgcagaaggagctgaggtccaaggggagcagcaacagtgacttgctgaaggtcacgcagcctcaggatgacagcccctagtctctgggtcctgggctccttcccccccagtctcctcactgccttttcctgtggcatctcaggcctgagacttgaaattcctggcagagaacctctacctgaaactcaagaaactccacagtgggttgcctgagctcactatgacatcagagatgtttgtgttcttctcctgcccaaattctgcccatggggaggcagccactccacccaaaggcatgaagatcataaaaccaataaaggaatttttttttcttttttcctccccaagatcagtctcctggctgtgtccttcttttttttttcgcttttgattttggctgcgctgggtcttcattgctgtgcacgggctttctctaattgccgtgaaatttctctaatttctctagttgcagggagtgggcttctccttgcagaggcttgtcttattgcggagaatgggctgtagggcttgccggcttcgggagctgtggtgcatagtcttagctgccccgcagcatgtgggatcttcctggaccagggatagaacccatgtcccctgtactggcaggtggattcttaactgctggaccaccagggaagtcctggctgtgtccttttaaaaaacatctcaagaactcaggcacgcttcgatcaacccacgtgatctttgtgtgtgcaagtgtcgtggatagaacagtgtgtcccaaagggtgtgctgaagttctcacgccaatgcctgcgagtgtggccttgtttggaaatcaggtctttgaagatgtgatcgagttggaggtcacactggataagaaggggcctaatccagtgacttatgtccttctaagaacatggtgatgccgagacacaggggagaaggtgtgtgagaacagaaccagactgtagtgaggcaattataagccaaaggatgcttaagatggggtgtcagaagccacaaagaagcaagctggatcctcctgcggacctgccaatccctccatttcagacttacatgttctgaaacggtgagagaacagatattaaagttatgctgtttgtggtcatttgttacaacagcctacagaggaaaacaaggcaggacgccagccatttcacgtggaagtgaaaatgttaagtcgctcagtcatgtctggctcttggtgaccccatggactgtagcccatcaggctcctctgtccatgggactctccaggcaagaatactatagtgggtagccatgcccttctccaggggttcttcccaacccagggatcgaacctgggtcacctgcacggcaggcagagtctaccgtctgagtgcttctcatggacgctctgacctcagccatccaggagatgctaagtaggcctgaatgcaggaggtgagcaaccctggcttgctggtcccctggactcgcaggggcagtggctgacccttgacaggcactgcccaggcctcagcccccacgcctcttctctgtcttccctgtctcactcagtccctaggccaccaaagtagccacagatgatacatcaaccaatgggcacagctgggtacctggaaaactttattggtgaacactgccatttgaatttcatacaattttcatgtgtcaaaaagttgattcttttcaacattttttttccctaacattcaaaaatgtaaaaaccactcttagctagcccttggtacaaaaagaggcagcaggctggatttggctcatgggtggtagtttgctgacccctgacctagacaacctccttgggtcccatgtggtttgggagactgcacatgcctcagggcaactaggccggtgtaccacaactactgagttggcaagctctaaagccgagcaagagcagccactgccaaggagaagctaaatatgtatcagttcagttcagtttctcagtcatgtccgactctttgtgaccccatgggctgcagcacgccacaggcctccttgtccatcactaactcccagagtttactcaaactcatgtccattgagttggtaatgccatccaaccatctcatcctctgtcatccccttctcctcccgctttcaatctttcccagcatcagggtcttttcaaatgagtcagttcttcacatcaggtggccaaagtattggagtttcagcctcaacatcagtgcttccaatgaacaatgcacaaatctgatccctatcttttacccagccttgtctctgagctttaaaggccccaatccatgccctcttggatgtctaatatgcattagacttcccaaatgtaacattctagatgcaactttttatttccctccccacttgaaatttatctcatccctctggctcccatctcagttaatggggttaccactgcctatcaggccaaaactctgtagtcatctttgactcctttctttttctcaaactccatgttcaatccatctgcaaaaactgtcaactctgtactaccttcacagtatacccgtatctgacaacttctccccacctcctctgttctcatccttatccaagctatcagcacctcccaattcaccgctggagtctcctaccatctgtttgccacacagcagccagtgaggtccctttgaacttgagcatcctgttcacctaccctcaaccctgcttctcatcctcccaatgctccctgccacccttagaataaaatccaacacctgaagatcaaagccacagtgagataccatctcataccacttaggacagcgaaagatcatctataccatttttctagattccaagtctgtgcattaatatatgatatttgtttttctctctctgacttacttcactctgtgtgacagtctctaggtccatccacatctctacaaatgactcaattttgttcctttttatagctgagtaatattccattgtctatatgtgccacatcttctttatcagttcccccgttgatgggcatttcatgctctggctactgtaaatgtttgcaaaacagaaatagagacacagacatagagatcaaacgtatggacaccaaaggggaaaggggaggtgggatgaactgggaggctgggattgacatatatactctattgacaccatgcgtaaaatagataagtaatgagaacctacttgtatagctcagggaaccttactcaatgctccttttaaatgttttcatcagttggcaatgcagttaacagtaggaaaaaaaaaaaaaacaattctccccaagagtaaaaccacaatgactcatgacttgttaaacctagatgtcatgggggagaggaggaaaggcagaggaaaagggaaatttactgattcttggaaaagaagaagcttcaactcaaaactgcattattcacggtaacatcactcattgtgacaagctgctgtgtttttcatgagggtggaagatgtgactcttcaggcgaatcagatggtatgaggatggtggagtcccctctcctcaatgaaaatggaataaactctattttcagggcggccaggagtgggtctcaagggagggatacagagggtgacgctgttctgggagcagtgcctgggacgggacatagagtgcccccgcctaggagggtggggtactcctggggctcgagccctccccacgggctcccagcagactccgtccattgaggtgaaacagtgaaacaggaagtgggcaggcaggccaggcgctccgctctgggcactgggctcgggctgggaggagggcagcggagacttccacagcggggctgtaggaaatttaccaggtggaacctggggagggaaagagtgcatgtgctttccccaagaaaagccctgaggcacttaggccaaaaataggtgagcatgtgtgtgtgtgtgtgtgtgcgcgcgcgcgcgcatgtgtgagagtgtgtgtgtgtgcgtgtatgtgcatgtgtgtgtgcatgtgtgagagagagtgtgtgtggtgtgcatgtgtgagagtatatgtgtgtgagtgtgagtgtgtatgtgcgtgtgagtgtatgtgcttgtgtgagagtgtgtgcatgtgtgagagtgtgtgcgtgtgagagggtgtgtgtatatgcatgtgtgagagtgtgtgcgcatgtgtgagtgtgtgaaagtgtgtgtgcgtgcacgcatgtgtgtgcgcatgtgagtgtgtacacatgtgtgagtgtgtgcgtgtgtgtgtgtgtgtgagagtgtgggggggcccgtgcgtgtgtgtcaagttctggtcatttacgaagcaggctctgcggctctcgcctccttaatcctcccacccctagcgctacccccggcccccaacctccgcctcttgggtgttccacgtgtctgagcatgcctggcagcgtgagaggtaacattccacacccccacctgccgcaccccctcccagacgctaatctgcgtgtaccaagctgtcgaagtgtcaagctgaaaggaacggaaagttaggctgacaagctgggctgaaggctgaaaacaacaaccgtcatcagcgggcgggaggggctgttgtatttacagtctactctgatccctgccgccggaatgtatccccgtgggaggtagctagaggaagacaagtgaacatcgcaggagttgttttaccccaaatattaaaaagccaacccaagcaactgaggggcccatcactggctccccaccccccagcgctgttgcacagagagcccagccccgcagtttcctgagaaccgcagcggatgcagagtcgctctggccctccgagcaaaataagcgagagaggcattggttgtgtggagaagtggcaatgacctgtgggaggcaacttccactgaaggcaaaaatgaggtgatttcacccagctctgcagatccttgaatgtaactgagcaggagaggaggaccacgtggaacactgctgaaaggtggacaggttactttcatgaacgcttgctgtgggccttctgggcacactcaggagaaaactggaactggttatattcaaaggcaaccaggcaacaagaaaaggtggcaccgtgggtgaaagccaacagacaaaagaaacacaaagatttcagatccttcaattactagacacagactcagtcaattctgtctaagaaataatcaacaagattgacaattttagcaaaaaactgaaaatgataaaaaaagatccttctccaggggatcttcctaacccagggatcgaacccaggccttctgcataccggggagattctttgccacctaagccaccagggaacccccaaaaagtatcacaattgatattaaaaagaatttctagttgtgaaacatacattagttagaattaaagattagaggatgatttttttaatgatttttgtaatgattactcacctgaggatgttaatgggcaaattttttaacttttatttttggcgataccaagcagcatgcagaatcttagttccctgaccagagattgaacccaagtcccttgcagaggaccagagaaccttaacccctgggccaccagggaagtcccctagtagatgattttaatgacacttttagacacaactgcagagagaatttgtttcccaagactaaagcagaaaaagctatcaaaattatattctggaaagacaaaatgattaaaaagttcaggtcagttcaattgctgtgtcgtgtccaactctttgcaaccccatggactgcagcacgccaggcctccctatctatcaccaactcctggagctaactcaagctcacgcccactgagtcagtgatgccatccaaccatctcatcctctgttgtccccttcttatccagccttcaatcttttccagcatcagggtcttttccaatgagtcagttcttcatctcaggtgcccaaagtattggagtttcaatctcagcatcattccttccaatgaatattcaggactgatctcctttaggatggactggttggatctccttgcattccaagggactctcaagagtcatctccaacaccacacttcaaaagcatcaattctttgctgctcagctttcttcacagtccaactctcacatccatacatgactagtggtaaaaccatagccttgactagacagacctttgttgacaaaataatgtctctgctttttaatatgctgtctaggttggtcataacctttcttccaaggagtaagcatcctttaatttcatggctaaaatcaccatctgcagtgattttagagccaaaaaataaataaataaagtcagtcactgtttccactgtcaggtattcccatctcttgaagaattttccacagtttgttgtgatccacatagacaagggctttggcatagtcaataaagcaaaatagatgtttctctggaactctcttgcttttttgatgatccagtggatgttggcaatttgatctctggttcctctgcctcttctaaaaccagcttgaacatctggaagttcacagttcacatacatgttgaagcctgacttggagaatgttgagcatttctttactagcgtgtgagatgagtgcaattgtgcagtagtttgagcattctttggcattgcctttctttgggattggaatgaaaactgatcttttccagtcctgtggccactgctaagttttccaaatttgttggcatattgagtgcaacactttcacaacatcatctttgaggatttgaaatacctcaaatggaattccatcacatccactagctttgttcttagtgatatttcctaaggcccacttgactttgcattccaggatatctggctctaggtgagtgatcataccattgtgattattcgggtcatgaagatcttttttatatagttcttctgtgtattctgaggttactgctgagttttccaaatgtcctgccatattgtctcaaggcaagaatactgaagtgatttgccattccttcctcaagttgaccacgttttgtcagaactctccaccatgacccgcctgtcttggatggccctacacagcatggctcaccatttcattaaattagacaaggctaactgggagaaatatcaataacctcagatttgcagatgacaccacctttatggcagaaaatgaagaagaactaaagagccttttgatgaaagtgaaaggagagttaaaagttggcttaaatctcaacattcagaaaacgaagatcatggcatctggtcccatcacttcatggcaaatagatggggaaatagtggaaacagcaccagacttcattcttttgggctccaaaatcactgcagatggtgactgcagccatgaaattaaaagatgcttactccttggaagaaaagttctgaccaacctagacagcatattaaaaagcagagacattactttgccaacaaaggtccatctagtcaaagctatcgtttttccagtagtcatgtatggatgtgagagttggactataaagaaagctgagcgccaaagaattgatgcttctgaactgtggtgttggagaagactcttaacagtcccttgaactgcaaggagatccaaccagtccatcctaaaggagatcagtcctgaatattcattggaaggactgatgctgaagctgaaactccaataatttgaccacctaatgcgaagaactgactcactagacaagaccctgatgctgggaaagattgaagacaggaggagaaggggacaacagaggatgagatggttggatggcatcaccaactcactggacatgattttgagtaagcttcaggagttggtgatagacaaggaggcctggtgtgctgcagtccatggggttgcagtgtcggacatgactgagcaactgaactgaactgaactctgtgtattcttgccacctcttcttaatatcttctgcttctgttaggtccatatcatttatgttttattgtgcccatctttgcatgaaatgttcccttggtaaatctcattttcttgaagagatctctagtctttcactgtgagtagatttaataaacatttaatgtaagtatcagttggagtaaaaagagagaaaggcatagaaagaaatatttaaatataggctgatagatgattatcccaaactgatgacactcacccacagaatcgagaccaacgaactcccagcaagacaataaaaaagatacccttatattcggaaaagagaaaaagagaggggaaaagaaaatcttaaagcagcctgagaaaaaaggagcttgcctttaaataagtcatctgtaattccataattgcactactataacacaaccactgcaagcaattaaatgtattcccctccactaatctaaggaagagaaaaaccattaaaagaagcaagtgtgaaagtgttcattgcttagtcttgaccccactctttatgacccacggactgttagcctaccagcctcctctgtccatgggattctccaggcaagaataccagagtgggtagccattcccttctccagggcatctccccagtccagggattgaacctgagtctcctgcattgcaggcagattctttaccgtctgagccatcaggataaacattcaactgactccttaaaacacaatgaaagctagaacactgtgcaacgatgtctttgatttaccaagagaaaaacgctaaatcctctacccatggaaaataccctcaagaattaaagtgaaattcagacatttggggataagaaaaaaatgcaaaaaagcattcaccaccggcagaccaccatctgaaaggaaaaggaaaataactccacatggaaggtttaaagtgtaagaaagaatgagaatgaaagaatgatgaatactttcatgtgaaaaagttgctggactgtcatcaaatcagaagtgtacttgcaacaacctaagcttgggttcgagtcattgacttcgaggagccttttgtgcatgtatgcatgtgtttagttgcttcattcgtgttcaactctttgcaacactgtagtttgccaggctcctctgtccatgtgattttcctagcaagaacactggagtgggttaccatgccctcctccagggcatcttcctgactcaggtcgaacccgcatctcccgcatctcctgcattgcaggtggattctttttcgatgagccaccagggaagccccaaggagccttggacagacctcaaagatcaggccagcagccatcctcagctgaagctgagccagcaggacccacctggcgacttgatcagaagaggcatgtcatgtccagcaagattcagagaaagtaaaatgggtgttctaacatgagccagaaatggaaaatcacaaagacgtttgccatggtaggtgctggtttgcaacaacactgattctctcatgacattcttcagtgtgccccagtgtgagaaacttcaagggtctgtttattcaggcttggttaatgatcacccagtctctccagtaatcaatgaaaaaaactatacccagcataagaggaaaaatctgtatggtcatgtaagttggaggggacttccccactggctccgtggtaaagaatctgcctgtgatgcaggagatgccagttcgatccctgggtcaggaggatcccctggaggagggcacggcagccccctccagtgttcttgcctggagaatcccatggacagaggggcctggctagccacagtccatggggtcacaaagagttggacacgactgaagcgactgaacacacacacaagcacgtaagttggagatgacactggcttggagtggagtggtggccacgcatgtgaaatatgaaacgtgttttggagggataggagatctggggtggggaccaaggatcactcaaaaaacttaagagactggggggtgcctttgactgagacgagaaagacatagaaaagtacactttataaaatttcaggacaagagtcaggagaaagcaggttcaaattttccattttagacttttacattgataacacctgtgagacctccaagtggaagacatcacttttgcaatgggagcccagaggaggggtttaggctacagatataaaccttggaattattagcacattatagatggtatttaaagctagggtatggagaaaatgcatctaacaaaaatgtgtacaaatttaaaatacacataatttttagaaagaaaataaaaatcatccatcatccatgaacagatatcatctagaaatgatctaaccacctaattataaacttatagaattttgtattgtccacatatggagaaggcaatggcaccccactccagtactcttgcctggagaatcccgtggatggaggagcctggaaagctgcagtccatggggtcgctgagggtcggacaggactgagcaacttccctttcacttttcactttcatgcattggagaaggaaatggctgcccactccagcgttcttgcctggagaatcccggggacgggggagcctgttgggctgccgtctgtggggtcgcacagagtcggacatgactgaagcgacttagcagcagcatatatgtatcaccaggaagataatgttattgatatttaattggccttagccacagtttccttatacccgtgaccccctcttctttcctaaaacctttatggggagcagtcgagccatctgatgcccattgcctcagcaaagggatgtgataatagactgtcttctagtttttaagtttccaagggcttccctggtggctcagatggtaaagagtctgcctgcaatgcaggagacctgggttcagtccctgggtcagaaagatcccctggagaagggaatggctacccactccagtattcttgcctggagaattccatgggcaggagcctggtgggctgtagtccatggggttgtaaagagttggatacgactaagcaactcacacaagggacatggaaaggatcaagatcactgttagctgacaggttgcagagtgccccgagaacacatgttccagcttaagtgaagttcccctggagtgagaggagagggaggaccactgggaagcaatgggcctcaagggctggtgggtcccaatgagaaggaccctctatccccaccccagggcaagtgctggactgacctccctgtggatctgatagcaggggagtcctgtgcctctttgctcaggttccacccagcgagcagggcctagaccccaaagagagaaaggctgccaggtgaaggggccctggccccactgtaagggagaagcaggggcaggttactgtgcagccaagtgtggatgggaaacgcagagcttatggaccacacagagcttccagcaggggagggatccttggcaacctgtgtggaccagtgaccatggacaactctacgggcattcagcaaggactggagggacccccggacatatcttggcccgtcaaagccccttgggacatatataaccctagggaaaacctggaaacctaagatgacatagaatcatgggggctcaagacaggagttaaattctgctagggaagaatttctaaaagtcatacttcctgtggtatatcaataaactactggaagtgggctttgcagagaggttggagattctgcaagagcaggtaaaagtggaagaaacaccatccattcctattcatggtatagcatcatatccccagggtgatggggtttgggaagggtggcagggaggaagggaaggacagaaggagggagggaggcaagagagtagagggagtgagaggagagagctaagacagagggcaagccctctccagtacctgcgacacagatggtgagcctggggaaaacgccaatcacgcccacttcacccatcactggcacaccacctcacccagtgttcagttcagtccagtcgctcagtcgtgttcaactctttgtgaccctatggactgcagcacgccaggcctccctgtccatcaccaactcccggagtttactcaaactcctgtccatcacgttggtgataccatccagccatctcatcctctgttgtccccttctcctcctgccttcaatctttcccagcgtcagggtctttttcaatgagccagtttttcacatcaggtggccagagtattggagtttcggcttcagcatcagtccttccaataaatattcaggactgatttcctttaggatggactaagactctaataaacgtttgtggaatgactgaatggtaggaacacaataaatacttgttgaataaacacacatacagtatatgtgagatacagagtttgttgaagcaacttattcaggaggttgttggggaacaaaaatagaaggaaaaaaattgatctcatctaaatccaccatcccctgaaatcaaaacattaaatctttcagtactccctcctgctgtgttctggatcaaggtggagtcagaacatcaagctgtgattgtttttctgaaaaagttttccttctcttgcaatgagcatttgcagttgcagccattaggctcctagaggttggagtctcatgcccaagtccctgctgtcagtgtgaagggctggatcccatgcactttgttgacacctgtgctttgggcctgtagcctcccggcccagtggtccttatggcagaggctgacccagccccagccgcaggtggaccctgttgtggtcctgacacgggcactgccatccctccatcagaagtcccggtttctcttcctcatctgagtggttgatcttagagatggctttcagcttaaatgtttggtgattctcagcttctttggttaaagcagctgattgtcatgagggattgattccaaacctgtgtgtcagcactgaagctgtcataggaagaagcctggacctccccaggacgtgaatcccaggcgtgaagaatgttctcctgtctggccaatgagccaggcttaagagaaacctggagtaacagggaagtttggctttagagtataaaatgaagtaaaggcaaaggctaacagggttttgcaagagaacgcactggccatagcaaacaccctcttccgacaacacaagaagactctacacacggacatcaccagatggccagcactgaaatcagattgatcatattctttgcagccgaagatctaaaagctctataatagtcagcaaaaaacaagaccaggagctgactgtggctcagatcatgaactccttattgtcaaattcagacttatattgaaaaaactagggggaaacgctagaccattcagatgtgacctagatcaaatcccttatgattatacagtggaagtgcaaatagattcaaaggattagatctgatagacagagtgcctaaagagctatggatggaggttcatgacactgtacaggagacggtaatcagaaccatacccaagaaaaagaaatgcaaaaaaacaaaatgattgtctgaagaggccttacaaataactgagaagagaagctaaaggcaaaggagaaaaggaaagagatatccatctgaattcagagttccagagaatagcaaggagagataagaaagccttcttaagtgaacaatgcaaagaaatagaggaaaacaatagaatgggaaacactagagatctcttcaagaaaactggagataccaggggaacatttcatgcaaagatgggctcaataaaggacagaaatgatatggacctaacaggagcagaagagatcgagaagaggtggcaagaatacatagaagaactgtacaaaaaaggtcttaacaatggtgtgatcactagcattgagccagacatcctagagtatgaagtgaaatgggcctgaggaagcattactactaacaaagctagtggaggtgatggaattccagctgagttatttcaaatcctaaaagatgatgctgttaaagtgctgcattcattataccttcaactttgtaaaactcagcaatggccacagggccggaaaaggtcagttttcatcccagtcccaaagaaaggcaatgccaaagaaggttcaatctaccatacagttgcacttattttgcatgctagcaaaataatgctcaaaatccttcaagctagacttcaacagtatgtgaactgagaacttccagatattcaaactggatttagaaaaggcagagatcaaattgccaacatccattgaatcatagaaaaagcaagagaattccagaaaaacatctacttctgctttattgactatgctaaagcctttaactgtgtggatcacaacaaactgtggaaaattcttcaagagatgggaataccagaccacctgacctgcctcaggaagcaacagttagaactggacatggaatgacagactggttccaaattgggaaaggagtatgtcaaggctgtatatttaacttatatttaagctatttaatatattattacattaaataatatattatttacataatatattaaactgcttatttaaacctctttatttaacttatatgcagagtacatcatgagaaatgcctggctggatgaagctcaagctggaatcaagattgccaggagaaatatcaataacctcagatatgcagatgataccaccctagtggcagaaagtgaagaggagctaaacagcctcttgatgaaagtgaaagagaagagtgaaaaagttggcttaaaactcaccattcaaaaaaagaagagcatggcatccagtcccatcattccatggcacatagatggggaaacaatggaaacagtgaccgactttcttttcttgggctccaaaatcactgcagatggtgactgcagccatgaaattaaaagacgcttgctcctttgaagaaaagctatggcaaacctagacagtgtgttaaaaagcagagacatcactttgctgacaaaggtcgatacagtcaaagctatggtttttcccagcagtcacgtatggatgtgagaaatggaccatcaagaaggctgagcatcaaagaattgatgcttttgaactctggtgttggaaaagactcttgaaagtcccttggacagcaaagagatcaaaccagtcaatcctcaaggaaatcaactctgaatatccattggaaggactgatactgaagctgaagcttcaatactttggccacctgatgcaaagagccaactcattggaaaagaccctgatgctaggaaagattgagggcaggaggggaagggagtaacagaggatgagatggttggatggcatcaccgactcaatggccatgagtttgagcaaactcagggagagagtgtaggatagggaagcctggtgtgctgcagtccatggggtcacaaagagttggacatgacttagcaactgaacgacaacaaaaaaccaatacaaaattaaaaatgttacagaaagaaaaatgtcacatctgattattatcacgttgagcttagaaccagaaaaaaattgcatttgtgggtttaaaaaaaaaaaaggactcgcctaaagctgaaatgcaatgagaagtttataaatgcaggttataaacaggtgatgggtgagatgtgatttatactctaagaccagctactcttgagaagaggaagcatctgaggcaagttagagcagaggtgagttctgtgtttttccctgtggtgctggtaacaaagaaggaaaggatggggtcaacctggcaggcatttcagagctgtcatggaccagacctactgctggttgggaggtggctcctgagtgatcagggagccgccgggtgccctctctgctcggcctctcgggctcagcatttccggttccggccagtctgtcttgtttcctcatcctcattcctccaggcttggacctggccactccctaccttctgacacttgactttgaacaatccttttcctgtgtttgtctcttttccctcgtcacaccaacacccagttctgctagaagcgtctgtgtgtgtctcatctccaggtgggcccaagttctcagagggtccttccccttgtgtcctacatcacctctgatgatgcccacgtgggcatctcccacttggaccccaccccctgactccaaaattcatatctccagctgccccctgagtgcctctgttgtaacagcaaaggggcatctcagacaaagcttgttcaagactgagctcctcaaatgccccccaaactttgttcccttctgatgcttctcttttcgggctctactctccaaaggcatcctcagcctgatcgcttctcacaatctccccatccctccctgcttcaagctacctgcatctgccacgtggataatggccacggcctcagatggaatccttgagtcttctctctgatgtcacctgcagctgctctgccccgctcactcccctcccaccatatgctcttcctttgccacagggagcttgctcccccaatcagagtctctgtttgcctggaagtctttcccctatgtatctgcttggagcatcccctgtctccttacacaaatcccccttcttggtgaggtctttcctgatcatcctaatgaaaacagaaaataacccccttccctgatccctgacttccccctaccccactttcctgatctatgtcccccatagcacagatgatcttctactattctataggtttttgtttaggggaaacttactagtttcgttttgctatctttttatgtatcgtctccctcttcttgctggaatgtaactccacaaggtaggagtgtttgtttacgttgtcatcttgtgtgcccggctcctgaaacacttgagcagagccagcttgcacgcagccatgttggccttgtgctcagggggccctgcacttggtttaatgctctgctgttcatattttgaaatccttaatacattctgaataaaccctcccccctatttttatttcatgtgaaaattatactgccagacatacagtaggcactccatagataattcatcccttggccaggtggagtccctttttaagtcatctctgaagcctgagaggcagtgctccaccaagaaggactttctttataaacaataaggatgtgtttgtttattcctgacctcaccacacagcatgcgggatcttagttccctgaccagagattgaatccgtgctccccgcagtggaagtgtggagtcttaaccactggacccacagggaagtccccgccaagaaggacttttaaacctcaggaagcaagtggtgaggccctgggatagatagggaccccgaagccctgaagttacccccgaatgtgtccacacacatggggactggccccagagaaaagagatggaaaaatagtcttacttggggccagagtctagaaaactgtgaaaagctagggaaatccattttgagtaacacctttaaagaagaagagaaaatgaaagtggttaatcataggatgagctttgttagacaaaaatggcaattcaggtagaaagacacatttacagacatctcatgggggcggggtctggtgattaagtcagaagctaccatctgcatccctgggaacttacaagctaaaaatggggactagaccttatttatgaaatacacagaaaaccattctacaggagccagatgaaaagatggcagttccaaatagttcatgctggtatttgtctttgtggtttcatctgaaaacagagtatgcctgaaattctcagaatttataaaatttatgaaatacataataatacaatatagactttaaatgtgaaaataatcaataaatatataaacatatcctctgctgctgctgctaagtcactacagtgtctgactctgtgcgaccccatggacggtagcccatcaggcccctctgtccatgggatttcccagataagaatactggagtgggttgccatttccttctccaggggatcttcctgacccaggtactgaacctatgtctcctgcattggcaggtggatgttttaccactcagccatcagggaagcccttatgactacaataaataataatacgtactatatataatattatgtaagaataaagattgagaaatacatataaagataaaagtattaaaattgtgagcttgctttttgcactcagacccacttccctatggtattaggaggctttaattggcaaataagagaaagcaaaaccggtccagcttaggacaaaaggggattttacttattaatgtagtatttctgctcggggatgagcaaggttgggaatttgtccaccacccttggcccctgacggagaaggcaatggcaccccactccagtcctcttgtctggaaaatcccatggatggaggagcctggaaggctgcagtccatggggttgctgagggtcggacgtgactgagtgacttcattttcacttttcactttcttgcatggagaaggaaatggcagcccactccagtgttcttgcctggagaatcccagggacaggggagcctggtgggctgccgtctgcggggtcgcacagagtcggacaggactgaagcaacttagcagcggcagcagccctggcccctgaagcttggccctcccagacagcattccttccagctctggctgcagatcctgggtcttcggccagagaaacgtgatgcctccctcccaagtcttcatggcctgatgcccagaggggcaaagaaagcatctctctctcccagcagggacatgtgaattgtggacgagctggctggctctgcgtggtcacatgtccttcccttgcccttctaggttggcaagagccggggaggaccctgattggccagaactgcatcattgttgccacctccttgggggcactgaggctcagaaccacaccagcttggggagcaacagcttctcaaaggaacagggaaggagaacagcagtcattttcaaatagcccttctttcaccatgctaacaaaagacattttctttccataaatgatgcaaagcaccgctttttaaagaacatttatgaaaccttttctcctggatatttccataaaccaggtgttttgcattccagtcaaagacttggatgaaaaattccccaacctaaagatcagcttatttcttattttaggagcagttgataaaatgtgggctctgacagtaaactgaaaaacttctgcacagcaaaggaaaccatcaaaatgagaaggcaacctactgaataggagaagatatttgcaaatcttatatctgttcagggcctaacatctgaaatatataaagaactcatacagatcaatagcaagcaatctgattttagaaatgggcagaagatatgaagagacatttttttcacagacaatatacagatgactgagacacagaagaaaagatgctcaatatcagtcatcatcgggaaatgcaaatcaaaacacaatgagttgtcatctcacacctgttagaatggttattatagtattttaaaagacaagaaataacaaatgttgtccagggtatggagaaaggggacactctcgcactgttggtgggagtatagattggtgcagacactagggaagacaatatggatgttcctcaaaaaaattaaaaatagaactaccatatgatccagcaattccactcctgggtatttacctgaagacaatgaaaacactcatttgaaaagctatatgcactcccatgttcactgcagcattatttacaatagccaagacatgtaaacaaactcagtatccaccaacagatgagtgcatatagaaaacgtttacatacatacaatctcatactttctctatatgtacataattaaatattactcagccataaaagagtgaaatattgccattgagggcactatggtgaataaaataagtcagacagagaaaggcaaatatcacatgatcttacttatatgtggaatctgaaaaaagcaacaacagagctcatatatacaaagagaagattggtagttgccagaggcagggagggcaggtcgttgggtgaaatggctgaagaggctcaaaaggtacaaagttctagttttaaaataagtcatggtgacggacgtcatgtgcagcatggtgactacagtcgacaaccttgtattacacagttgaaaggtgttaagacagtagatcttagaagttttcatcacaagaaaaaagtttctaactatagatggtgatgggtgttaactagacttaatatggtggtctgttcagcaatatataaaaacattgaatcattatattgtacacttgaaacaagtataatgttacatgttcaacagacctcaattaaaaatggaacaaaacaaacaaccacaaaacatgggctccgaagtcagacaaacctagatttaaatcttgtttctgttgtggagtgtagcaacttgggaacattatttaggtcgtgttggcctcactttccttgtctgtaaaatggggtaaaattacacccctcttagttttatgacaaagattagataagattacatgtgttaggaaatatcacagggtcttgtcttatcttatcttccccttcgagtactaaacgggcagttctttaccccttgggaagtcttaacaaaagtttctttctttcccttcctcgatggctactggaccatatctatgttctaaggagcctgctccaatgcctgtcatctccttccagcaaaggaaaggtggaaaggactgggaatggagaggggatcatccttccaattctttgagggccaggtcaagaaatgactcccctcacttctgccaacagttccctagtcacatgaccaagcccactgcaaaggagcctgggaaacacagtctttagccagagggccatgttgccagctacaatgttacagcatgaaaggacagaagaacccaaattaggggacggtcagctgcctaccagagcctctcaggacctcattaaaaaggcaggagtgatggttacctttcgagagggcttttgctggattcccgcagcagcagggcatgatacaaagccaaacaccccacaaaccagaagggaatttaggaaatgattcaagctccctgggtgactcatatattgaacatcctggagagaaaagtagccatacacccatttgaggcttggggtttagtttataataataataatgactttggcacagaaaacttcctgagggttaatgaatgactggcttcgattaatagcccaaatcgctgcctgaagtctatcaactccttccagcttcatttaatctacaggaaattctttgtacacccagctattactgcttcaatctcacaaaataaaaatgaaaggatgcttcattggaacttggggggaagggggaaacttggtccccattgtgtgtggcctccaggctattattactttttttcaggcaaatttcctgccttttttttttccttctctttctggcttccatttgcttcagtggcagcaacagcagtagcagctggccctctagattagctttaatccgcttgctatttatagcacactctgtaaacctcatcatacttgtgattccctatttaaatgtgtcttcctcactagactgggagctccatgaggtcagaggtagagtagactctcaactgggcacggcctggccacagcccagctcagtaaccacctgttgaatttaaccaaacagagtagtacttaattctgaacaacttgccaccagtcccagtgcatgcctccagcccaacctgggaatctctgcgtttagctggatttaagatagtgcacttttagcccatcaaaatttaatcagagtttcccaaaataacaacttgaaacaggcaagtttgtagaaatcgctgtagaagataatgtctaatgccatcaagctgtcaactgtgaagagaaaccagggacatgctaacgtaactggtgattcttcgtgcctgtagggacacccacttcttccctggcctccaattctcttccagtagatgtcactgacaaaataagcatgtttcccgtggcaaagtcctctggtttagggaattagagttggggtgccactagatttcctctaccatggtatttaaactcctaccttcctttttttttaaaaaaagatttgtttattcatggctgtgctgggtctttgttgctgcgcatgggatttccctacttgtggagagcaggagctacggtctggttccggtgttcaggcttctcgttgcagtgacttctcttgcggagcacagactctaggttcacgggcttcagtagttgtaggtctcgggctctggagctgtggggcacaggcttagctgcccacgtgggatctcccagaccagggattgaacctgtgtccattgcgttgacaggtagattcttaaccactggaccaccaggaaagcccccaaactctacagtcttgtctggcacacagttggcatccatgaggacctgctaagtgaaagaagaaggccccaagcaaagctctccccagcacatcttgccattgccgcttggtgagccaagcaaatgcagtggtattggcaggacctcgtctcagtggaggatggccacccaggtcatccataatctaccttgattccacactggtccctccaagtgagcttcagacagctctccacctcaattttctaattaaaacaagtcaggacttccctggtggtccagtggttaaaactcctcactcccaatgcagggggcccaagttggatccctgttcgggggactagagcccacatactctaggacctggcacaaccgaattcaacaacaacaacaaagccaagcgagtcccagctacagaaaagccctggcaacagaggaggtgttggtggctttaaaaccagcagtggagactaagttgaagaaacaggaagcctggcacagtcagcgggtggggggaggttaggtgggaataggattaaggctttagaaaatgcgtgtttccttctgttgtcctctcaagagctgataaggggatttcagagtttttgaggtggagggagccttggaaaagaatgagggcacttaatcaactaaagagactttcccaactcacctttctcagtgttgttacacggtatgtttccccaaggcaaagctgccaaaagtagaaatcaaagcccatcacgttatgctgtgacacactgtcgtcttctggctaggggtctttgacttttgtttttctcttcaacccaggacacgaagtgtgccgtgatctctcagataataccatgatattgtgtccaagtaatatgcatcctagacagagaaacctggagtgctatagtccacgggttacaaagagttggacacaactgagtgactgaacaacactatgcatctaaatagacatcatttgtacataaacatagagattattaaggctaagtgaggccaacggttctgtatcaaagagagtagcatgtagcgacgttttcacatgaaaagatcattgatagctcagcaagactttcctgatgaattgctttctcggaagatgaactaaggacagacagctgcgattcttcttggagagctttcagaaagagatgctttccccattccttctagtaagcaatggagacattccttcacttctctggaccccagagtccttgttaagtgaaatgagataactttctcagcctactctttctggggtttcagaagagctaaaaatgaaagagaaaattcaacaaggtcaggtgaacaggcgtcaaggctgggctctggcacaaaagtgaccagcatctattcatggatgagcttgccttctcacctccttcaggaaagccaaatgttgaagttcaggacctcccatattgcagtcctggctgcaattccatacgactcacattctgttatttagcaggactctcaaggatctttgctttcttgcaaaccttacttttagtccactgctggaggtgagcacatgggatccagaaggccgtcgctttatatcacaatacgaggactgcaatgtgggcagagaaaaacacagcccaaacctgagcttaatgacaccttttaaaagctactggtcctagtcacgtttttacttggtgtgtctcaatttcctattggctatagtttaagaaacaaatgcagttcgatggtatgctgtctttcagatgcttccctctcctcctgctagtgtcctgcatgccttgtgcgcatgcacacacacacacatgctcagttgctcagtcgtgtccaactctttgcaagcccatggactatagcccgccggctcctctgtccatggggattctccaggcaagaatactggagtgggttgccatttcctcctccaggggatcttcccaacccagggatcgaacctgtgtttcctgcattgcaagcagattccttaccgctgggccaccggggaagccacacacacacacacacacacacacacacacacacacacacacttgcatgcttacttaatttatctgttttccaattattgcacctgaactgctgcagtctcagaagcagcatgaaatagcagaaagaatgtgaggcttagaatcaaaaggccagagtgtgaattccagctccacttacctgctgggtggctcaaagcgactcacagtaaagctctctgtttactcattttgttagtttcctactgctgtacgttaccacaaacgtgggcttgaaataagactcatttgtcctcttagaattctggagatcagaagttctgcaactgacttcactgggctgcagtgctctgttggcaggcccacagtccttccgggggctccagcggggagtcagtttctttgcttcctccttcttcgaatgccacatttcctgcatttcgtgatttttggctccctcctccatcttcaaagccagcagcttaacatcttgcttcagtggtcacattgccttctttcctgtcgaacctcccccttacctaccttttttttttctttctttctgaccatgccctgcggtatgtgggatcttagacccctgaccagagatcgaacccgtgccccctgcagtggaagcctggaggcttaacaactggaccaccagtgaagtccctccctccaccttccttttataagaagatttgtgatggtatttagtgcccatctggatgatccaggataatagctttaagacctttaacttgatcacatctgcaacagctctttttccacataaggtatagtcacagagtccaggaatgaggccatggacatctttgggggccatttcagccttccgtactcatttattaagatagtaactcctatcctaaaggacacggaagtttgtttctatttagtttttattttcagctgtgctggctcttggttgtggcactcaggctcttgcttgtggtgtgtaggccttctctcgttgtggtactcgggcttcagtttctctgcagcatgtgggatcttagttccccatccatgaattgaacccacatcccctgcattggcaggtggattcttagccactggactagggaagtgggaagtcccaggacacaaaaaatttttaaaggcaaatgcacccagtagagttcaataaatgccatttagtttggaagagggagagattgccctcccactggtcagtctctactgatggacgcaattaagaatgagagagccacaaggagacccaaccagtccatcctaaaggaagtcaaccctgaatattcaccggaaggactgatgctgaagctgaagcaccaatactgtggtgagctgatgtgaagagccgactccttagaaaagaccctgatgctgggaaagattgaaggtggaggaaaagagggaacagaagatgagatggttggatggcattactgactcaacggacacagcaaactcagggagacactgaaagacagggaagcctagcctgctgcagtccagggggtcacaaagaattggatacaactcagtgactgaacaacgaccacgttaaagggagcaaaagcatgaggaaaaaaatacgtttttctaggacacgtatgtaaagatataaaaaaaagaagttattttcacaagtccaatttattttctaaacatacaatgctattctacttaccatggcggttagtatgacaatatttttaatgcctctcatccctatttactaatgttttggtctttgttatgggttttttttttggttgttttgctttgtttcatttgtttgtaatttgattaacagaaatacatttaaatctaccaaaaaaaaaaaaaaaaggatgacagagccagggctgctgtggactagggagtgactaagggctgagctggctatagatgccagtgatcttggccacagagtgactccaggagcaaagttcagaggaaggcagaagaggctccaggaaaaagacccaggggtttccctggtagtccagtgcttaggacttggggctctcactgcagttgagttggttcaatccatggtcggggacctaagatcccatcagatcccacgagccatgccccctgacaaaaaaagacacctagatgctcatgatcatagtgtcaaggctcactgatcttgtttgaccttgatgtggattcatttctcccaagtgggaagattattatttttactagagatcaatagtgttttcctggtggctcagtggtaaagaatccacctgccaatgcaggagacccaggagacatgggaagatcccctggagaaggaaatggtaatccactccagtattcttgcctggaaaatcccatggacagtggaggctggcgggctgcagtccatggggggctcacaaagagttggacacgactgagcacatgcatttgtagtacgagttaccctatgatgctgggaggtgtcaggctgaaaaccaccatcaagaagagtcttcatgcatttggggctccagctccagccacatcagcaaacatcttctttcatttccttgagctggatgttcaccaggcagttacgatgttattatacaggaagagaagacacacaaacatcttttgttctgcagaaggcagtgtggtcatgtgcccagtgggctattaatccttacttaatccttcttccccaggaagctttattatcctggggaatgcaagtactgttcggcatccttagggcagggggctgggccagtgggtgcggccacttccctggaattctgtcaccctccttctggcccctggggtagaactgccagtgctcagagatggaggtatgttgggaattccatgggggcagtcaggaagaatgggatcacaggcctacagttgggaaagaggacaaggcccggtgaggagctcccctagggaacacgtgggtcccccaggttcagtcatgagatgaggagttgccattgggctcccacccgatgcacctgtgaattctaatcacaagagcttgatgtatttatcgtttgatgaattgcctgagcctgactgatactgtttcagtttctgtaagggagaagggcttcccaggtgtcactagtggtaaagaacccacctgccaatgcaggagaccttcagagacccaggtacaatccctgggtcgggaagatcccctggagaagggaatggtaacccactccagtattcttgcctggagaatcccatggacagaggagcctggccagctatagtccatggggtcgcaaagtcggagtcaactgaagcaacttagcaggcacacacttgagggagtgaagtgaggcccccgtgtggctcttattccctttccaggtgcttctccagatgtccctccttggacccttctggtaactcagcaggtgactgagatgcaacgtcagaggtctcattctttgttcttcaccccacaggaatcagacccagagagcttgagtagtttctcagagtcacacagactcagactcaggcccagagctgactgtggctcagattatgaaccccttattgccaaattcagacttaaattgaagaaaatagggaaagccactagaccattcaggtatgagctaaatcaaatccctgatgattatacagtggaagcgacaaataaatccaagggattagatttgatagacagagtccctgaagaactacgggcctattgtacaggaggcaaggatcaagaccatccccaagaaaaagaaatgcaaaaaggcaaaatggttatctgaggaggccttacaaatagctgagaaaagaagagatgcaaaaggcaaaggagaaaaggaaagctatacccatctgaatgcagagttccaaagaacagcaaggggagataagaaagccttcctcaatgatcaatgcaaagaaatagaggaaaacaacagaatgggaaagactagagatctcttcaagaaaatgagagataccaaggaaacatttcatgcaaagatgggcacaataaaggacagaaatggtagggactgttagaagcagaagatattaagaaaaggaggcaagaatacacagaagaactgtgcaaaaattatctaatgacccagataaccatgatggtgtgatcactcacctagagccagacatcctggaatgcgaagtcaagtgggccttaggaagcatcactatgaacaaagctagtggatgtgatggattccagttgcgctatttcaaatcctcaaagatgatgccgtgaaagtgctgcactcaatatgccagcaaatttggagaactcagcagtggacacaggactggaaaggtcagttttcattccaatcccaaagaaaggcaatgccaaagaatgctcaaactaccacacaattgcacgcatctaatggtagcaaagtaatgctcaaaattctccaagccaagcttcaacagtatgtgaaccgtgaacttccagatgttcaagctggttttagaaaaggcagaggaaccagaaatcaaattgccaacatccgttggatcatagaaaaagcaagagagttccagaaaaacatctatttctgctttattaactatgccaaagcctttgactgtgtggatcacaacatactgtggaaaattcttcaagatatgggaataccagaccaccttacctgccttctgagaaatctgtatgcaggtcaagaagcaacagttagaactggacatggaacaatggactgtttccaaattgggaaaggagtacactgaggctgtatattgtcaccctgcttatttaacttatatgcagagtacatcatgcaaaatgctgggctggaagaagcacaagctggaatcaagattaccaggagaaatatcaataacctcagatacacagatgacaccacccttatggcagaaaatgaagaagaactaaagaggctcttgatgaaaatgaaaaagacaatcaaaaacccttgcttggaacccaacattaaagaaactaagatcacagcatcgggtcccacacttcatggcaaatagatggggaaacaatggaaacagtgacagattttattttcttgggctccaaaatcactgcagatggtgactgcagccatgaaattaaagatgcttactccttggaagcaaagctatgaccaacctagacagcaaattaaaaaacagagacatcactttgctgacaaaagtctgtctagtcaaacctatggtttttctagtaatcaagtatggatgtgaaagttgggccataaagaaggttgagtgccgaagaactgattcttttgaactgtggtgttggagaagactcttgagagtccatgggactgcaaggagatcaacctagtcaatcctaaaggaaatcaatcctgaatattcattggaaggactgatgctgaagctgaagctccaatactttgaccacctgatgagcagactcattggaaaagaccctgatgctgggaaagtttgaaggcgggaggagaaggggacgacagaggatgagatggttggatggcatcactgactcagacgtgagtttgagcaagctccaggagttggtgatggacaggaaggcctggcatcctgcagtccatggagtcatagagtcgaagagaactgagtgactgaactgaactgaactgatcattcctaaaggatattttctctagatacagaattctgggctaacaattctttaaccactttactattctaatgttttctggcctctgtggtttctggtgacaaatcctcagtcatagttcccctatatatatatatacatgcaggagacataagaaatgtgggttcgatccctgggtcaggaagatcccctgggggcaaggcatggcaacccactccagtattcttgcctgggcaatcccatggaccgagtagtccataggatcgcaaagaatcagagtcgattgaagcaacttagcatgcatgtgtgtgtgtgtgtatatatatatatatatatatatatatatatatatatatatacatatatatattcacaactccttaccaacgagcccctggggaagccccttatatgatatgttacttatatctggctgctttcaagaattttccatcacatttcattttcaactgattacgacgtgtttaggcataatttccattttgtttatcctgtttgtggtctattgagcttcttgcatctacagatatatatttttcaccaaatttaggatatctctgatatctcagtaattaattcttacatattttgtttccactttggtttccttcctcccttcttttggtgctccaacaacaagaatgtcagaaatatttatcattgttccacaggctgctgagattgttaaatttgtttttaatcatttttgtctttatccttcagatttaatagtttaatttatcttcaagttgactgactttgccatctctactctgttattgaatccattcaatgaatattttaatttcagatattactatttttgtctctaaaattcctcttgcactcttttttagtggtttctgttatctgctgaccacttctactttccatttgagggtgtttaccttataggtctggttctgataactgtttatgacatatacttaaagtatttgtctgatgattgcaatatctgcaccatctcagggtcagcatcattaattgccttttccttggagaaatggtgtcattttcctggttctttgtatgtcaagtaagtttgcactgtatcctgtacattttgaatattatgctgtaaaactctaatcctgtttaaaacaagcgaaaaacttccacagaatgctgacttttgttctgttgtgtttattctgtttatacaggcagccgacccatttgcgttcagatcataagtgccttcttgtcttctgtttctggggtccctttgtcaggtcagtggtcaaaacctttgcagcactggacattctgccagtgtttgccctggacattcgcaactctgggccaagctcaaggtttgcatgggttcacacacagaattatccagctcgctcatcctacttcatagctctctggactcccttttcttgtcttctggccagaagataagattttcctcagaatttatgatcacaactagactgccttctgatgaaagttgggacatgaaaggaagaaaaatgagaaatttacccctgaatgagtcattcttcaagttttgtctcccctccccaatctgattgctgttacctgagagtcctctagtaatgactcattttgtccggcgcttgggctgtgatcagtgggagagatagacttaagagggtacactccaggagaggaatctgtaccaggagaggaagctgatgtttcttgcattgaagttatttttaaaagcacttcagatacttttggatatacctaatatacccttctctcatcccttttcctcctttcatgtccagaaaaacaccaggctgaacttggacttcactgctcccaagtgtttcatgattttaatatgtataatacaaagattgtgtagtatagtcttacaacgttttaaacattatataaaatggccttataacgtaagtgcctagtatacagtcaacttctgtaaatgtcccaccgctgctgctgctgctgctaagtcgcttcagtcgtgtctgactctgtgcgaccccatagacagcagcccaccaggccccgccgtccctgggattctccaggaaggaaactggagtgggttgccatttccttctccaatacaggaaagtgaaaagtgaaagcaaagtcattcagtcctatctgactcttagcgacaccttggactgcagcctaacaggcccctccatccatggggttttccaggaaagagtactggagtggggtgccactgccttctccccatagttgcttagaaagaacatatatgctctattgttgatgtagaactacatgtctgattattgctcaagcttcttcattgtatgggctttccgggtggtgcaccgcctgccagtgcaggagatgtaagagacccaggcttgatccctgagtagggaagatcccctggagaagggaatgactacctgctccagtattcttgcccggagaatttcatggacagaggagcctggtgggctacagcccatatggcaaagagtcagtcaagactgaagtgacttagcacacacgcaggctttcaccgcattgttcaaatctcctaaaatcttactaattttctgtcttcctgctttatcgattactatggaagataaggagatcaaccctgggatttctttggaaggaatgatgctaaagctgaaactccagtactttggccacctcatgcgaagagttgactcattggaaaagactctgatgatgggagggatcaggggcaggaggagaaggggacgacagaggaagagatggctggatggcatcactgacttgatagacgtgagtctgagtgaactccgggagttggtgatggacagggaggtctggcatgctgtgattcatgagatcgcaaagagtcggacacgaatgagtgactgatctgatctgatctgatgggaggtatgttaaaatctcccaccatgactatgaatttgcccatatttccctgtaattatgtaagtttctgcaatatatattttaaggtgaccttgttaggtgcaatccagggggatatatcttgtgtgtgtgtatgttagtcgctcagtcgtgtccgactctttgagaccccatgaacccaccaggctcctctgtccatggacttctccaggcaagaacactggagtgggtggccattcctttctttaaatttacttctttattgtttattttcagctgcactgggtctctgttgctgcgtcacccgcttgctctagttgtggtattcggggattactccccagttgcagtgctcagcttctcactgcccatggtttctcatgttgcagagcacaggctccagggcaggtgggcttcggtagttggggcacacgggctcagcacttgtggtgcgtgggctcagccactctgcgacatgtggaatcttcccagatcagggatcgaacccatgtcccctgctttggcaggtagattctttaccactgagccatcagggaagtcccaggggggttgatcttaacgaattgtttcttttatcatgtgtagtgagtatttttctccccagtagtgcttttatgcctaaagactattttgtctcattttattgtagctacactagctttctcttgatttgtattctgttggtatgtgttttctcactattttatttactcttgaataatgtattctacgtataatacttacaatgattactcatatatttaggcttattactattgctttattttgtccttttctccttaccctaccttttctttttcttttctctttttctccttctattgggttgttgctgctgctgctaagtcgcccagttgtgtctgactctgtgtgaccccatagatggcagcccaccaggctccccgtccctgggattctccaggcaagaacactggagtgggttgcaatttccgtctccaatgcatgaaagtgaaaagtgaaagtgaagttgttcagtcatgtcaggctctttgcaacccatggactgtagcccaccaggcccctccatccttgagattttccaggcaagagtactggagtgggttgccatttccttctccattgggttgttgagttttcttgatttttctttccatttatgctacagacatatatttttaaaattctactcagaacttattgggcttctgatctcttaggattcaagtctttaataaattctaaaaaaattttagccattgtcactttgagaattgcttcttcctcgtgatctatcttctttttgaaaatcccattatccgcatatggaaaatctcttcctgtcctacttgcctcctcagctcagctcagctcagtcactcagtcgtgtctgactctttacaaccccatagacggcagcccatcaggctcccccgtccctgggattctccaggcaaggacactggagtgggttgccatttccttctccaatgcataaaagtgaaaagtgaaagtgaagtcgctcaatcatgtctgactcttagcgaccccatggactgcagcctaccaggctcctccatccatgggattttccaggcaagagtactggagtggggtgccattgccttctccgttatgaatgcctaaggtccaataatttttctcttatatatttgtccaacagaaatatcttatgttccatcaaaattaatgtactagaatattcaaagcagcagtattcacaatatccccaaactggaagctaacacaaatgtcatggatgaaccttcaaacccaagtgccaaattactgaaaccagtatcccaccccccgggttatccctgcttctgtcatgtgcttgatgttgtagtttgctattccctcttcatttggctgctggggatttcctttatttccttatgatctcagatctttacttaaaaggctgaacctgacagctcatccaggacatcaggtggatttgcaacagaaatgtcaccaggccacatagatcataacacgccctttccatgtccctaccaagatatgaagtcttcctgacactgtttttacagtctatatgtgatgtttgattgtaaaggaagaggagagggagaaagcgagagagaacatactttcacttaacacaaaagagactggggagcttagtgggggaagaacctcttcctgcatgtcctctgctaagaggcccaggtgtaatacattccacatccttgctgccctacctggccagacaccaactgcttgacagctctcaggacccacctctggtcccatgaggttggcagctattagtggagcctccctcactcagatgagcaactattcacccccatcagaccccagggtcctgtgacccgggctggaattgaggctgtcaagccctactgacaggtgtgcaaagagggtgggcgtgagaacagtcctccacctccacagtccttgtgaaatccccttcaaggtcacacccttgtgatggaagaaagatttaatacctgggtgcagcttgcacttcttgtatcctaagtttcaacagtccatgaggtcctggtgctatgtccccaggccatgtccaaaagaagaaaactgttggccagctggggaaagagttgttcctcccagggagctaggctgggccccagaggccatgattgtgagcttcctgcaaaccacctctctgtggttgagtggaagttgttcagttgctcagtcatgtctgactctttgtgaccccatgaactgcagcacaccaggcctccctgtccatcaccaacttccggagtccacccaaacccatgtccattgagtcagtgatgccatccaaccatctcatcctctgtcgtccccttcttctcctgcctttaatctttcccaacgtcagggtcttttctaatgagtcggcccttcacatcacatggccaaagtactggagtttcagcatcaaaggctttcacactttgaggtagaattggggcttcttacaacccactgtcacttctaacacatagcaaaagaaaatgtgtgggtaaacagcttcttttccagagagatgcttaggccaaaacaacaacagataagagttaaaagttctggagtattttgtgtgccaggcactgtcccaagaactttaaatggattacctcatttgtctcaaaataatccaaaaggtatgtattattatctcccacttttcctgatgaggaaactgaggctccaagaggttaaataaataacttgctggaagtgacacagtcaagcgacaaagcccgggcagagaacaagtctgtctcatgttccttgaccagacttctagatgtaaatatttcatcattgatcctggcctctatgtcacctctactgcacagagtgtcctgcctttggagcaatcttttctacctcgtcatgggaggagcagagaccctccctggtaggactcccaagggcccttcctcacccatttcctctgcctggccaccagggcagccctcctccccatcctcataaccagagtctcccagatgcactggcccacctgtctgttttgaatttactttgctcatcagtcttctccctcaactctgagctgctataaacctagacggatcccttgttcctcttcccaggctccgaaaaaggactggctgccccacgaaccatgggacgtggctcccaaaagctagtgctgggggtggtctgtttggctcttccttggctggaaacgccaggtcaggaaggcccagctttccttcaaggggagtagtttctctaagtgaagggttcagattcttgagggtgagaggtggagtctttaaatgtaaaaaaaaaaagtagtatttttggtaataactgaggaggacttgctggcactaaccatcttcagtggttgtggtttaaaagctaaaattagaaagtcaccttcagataaggcatcccacatatttcttgtttaaaagatcaacctcatggggcattagacatagcttcaatggcttcagagcagagggagcataaggtttgccagagctgttggaggaaaacccagcaaagtcatcctcctaggtttccagggaacacccttcagttttattagacctctatcaaattccaggtcttgaccaccaccaaaatctcgcagtcaaccaaaggttcctgccagccaacattgttcagttttataaggaagaacaatggtccaatgtaaggcccccaaaaccaagagataactttaaggaaggtgacagacatcataatcaacccaatcatcaagcatcaaccttggcaatccagctggatcctgtcctgattatccactggaaaaagtaggcaacatagaattctttgttgggctgaaccagatgacaccttaaattccctttcgactgagaatcatctgcgattcactcaatccttgtaattgttgttgtgttgttcagtcaccaaatcgtgtcctactctttgcaagcccacggactgcaacacactgggctcctctgtcctccactatctcctggagcttgctcaaattcatgtccattgagtaggtaatgctatctaaccatctcatcctctgtcgtccccttctccttttgccttcaatctttcccagcatcaggatcttttccaatgaatcagctcttcacatcaggtggtcaaagtattggcgctttggcttcagtatcagtccttccaatgaatattcagggttgatttcctttaggattgactagtttgatctccttgcagttcaaaggactctcaatccttgtaatatctgtcccttaataaacccaggaatattaatgcgttgacacactcaaccctccccaaaacccagtgaagtggtttttattaacatctttttcagaaacggggagagaaacttgccaggctgccagagctggttggagaaaagaaaggatttgaatgtaggtttgtctcaccccaaagctgatactcttcctgtccatccctctgcctctggcatttaatcagcttattcagcctgctgcctctgaaaaggaagtaaaggatacagacagctggggcccaggtggagaccccacccagagaaatgggcacttccagagcaaagctgccactccatgggccttgtgattggcagcccccaatggttaaccacagggctgtctccattgtagaaagaggctccctttgtccacacagccctacgctcaaacaatagctttatcacccaggagaccacagaacaaagggagggaggtagatatggacagaacagggtataaataagatgctgtatgggcagagagaggaaaaaaaaagatttaaagacagaacacaccaggatatctgacatgcaggcttttaaactatgcctacactctttatgtgtagagcatacacaaatgagcctgtattttcaactacgtcacatgccttgctttgcaaccaaaaacaatatttgcgcttcgtgtgctgcactgtggtgttcatccacagaatcacctggcacaggtcctgtactctagatgcaaatgaatgcttttgtgggggaggggagggagggcgggggtggggtgggggcgtgttctggaagccacactggctagctgacattgctgggcatgatggatgctgccagcaccgttgcttagcaacccagtacccttcaagacaatccagcggtctcgctggctcgaagaagcaagcagggttggttcagcatagcactggacatggaaagataataatggctctgttccagttattaataatcattgtttctgatttcctgtgtaggtcaacatacctgaggacacccagagccctgcactagactagagctgaaagaagcccagggtttttcaatgacttccaaatcggcttcagagagtagtggaattttactggctggtcccatgatgctcctgcaatcctggtcttttccacagcataaaggcagatctccatgccgtgactcaccagcatacctccagatagctgtttgtcagccctgtcatgagtcatgctttcttcagctttctttttttctcaaaactgagacacttgacattttagaatggggctgggggaaggttttgatattttttttttcctataagtctgtctgtggctttgtgtgcaagtgtggggggtgtgggggacaaggtgagtaatggctgcaagaacaggtaaacaggggtggaaagccctggaaagctttccaggtaaacagcacctggaaaggcatggagggaaagctgctgtcgtctgtatcacgcagggacggaacgcccctgggctgtattctagcaggagtggtaccctgggcggcagcctgccctccacccgttcctttccaggagcagactgctccctgcatcccagacaaagagaacggcttcacttcgtgcagtgtagatgacagcatcactctaaggctgttagaaaaatcctgcctgagttctaaggaacacaggaaattgagatttttctgatgcaaaaggtgaagctcaactgccacctagaaattgtgctggacagaacagacagcagaattccagggttctcattctgacgttcactgggaaagggatgaacttccatttattttgcatggcccagcacaagtctcttctcctctgtgaagccctcagcctcgtagatttattcacttagcacacccccaagtgtgagcacctcacggtcaggcagtatttcttatgtatcgtgtcagtcctgccccataccaagatgtgcacacgatgttcagtgcatgcttcttgtttggaggataaataacaaaagaattaattaaccagtccaataactaaatccagttaacctctggcaacctttatttgttcccatgcttaacaatacacagtccactcacagaaaagaagtagcaaatggaagcattttgaacattacataacaccatgttattacaatgcgtcattagaaaaaaaaaaaatgatgattgaaagtgtctccaaaggtaggaatcaggttcaattctatacctgatcgctaaagtagggaaggagaacattcaagttaatacaaatacttctcctattaggttggagtaatgcctaaaatttctaaaggatttccttctttgggttaagacattgcagatccttgtttaaaatgtaaatgctggactttcctagcagtccagtggttaagatccactgcagggggcacaggttcgatccctggtcagggaactagattccacatgccacatggtcaaaaaacaatgtaaattctctcttacagcaatcacacattaatctgttattagcctcaagcgttgtagtgatacgtactaaatccactccagagagtaaaggacatgagacaggaaattagattttactcttcattatgaaaatattcaaacatacaaaactagaggcaatagtataacaagtcttttttgtgttcatcagccaactttaacaactgtcatcctaaaactgatcttgcttcattcatctactgcccaaatcgaattatttagaagaaaatccaaaacctcctagtagttcatttatacatatttcagtatagagctctaaatataacctcctttcaacataaccacaaagtcagtattatacccaaggtaataaaaataataattcctgtgtgtgtatgtgtactcagctgtgtccaactcttttgcaaccccatggactgtagcccaccaggctcctctgtccatgggattatcctggcatgaatactggagtgggctgccattccctcctccaggggatcttcctgatacaaggactgaactcatgtctcctgcgtctccttcaggcagattctttaccactgagccacctggtaagccctaataattccctaatatcatcaactatctggtgagtaatcggtgctcagaagtttccctagtagaacagttcaggaaaagcaacgctgcatcagaacacggcagggactgagcctagggctggtcttacccatggggaggagacatgaatttcatcactttcactgtgttgtttgtctttcagtgtcacaattgccgagagcaatccacacatgaggaaagacatgaatatgtaaacaaaaatatgaattagtctccctactggccaatggcattcaccagctgttataaaaataataaagtttccctagcctggcagtcgtagcacttgattgtttaatcctcccgtcagcttcacctgaccataggtaagtcagaggtacttcttgagcctcagtttccttgtacaatggaggtaatagtaggacctaccccagaggactcttaagagcactaaagaacataatgtatgtaaagcacttagaaaagctcttggcacagtaaacctgtaatgaacatgaagcactgtgttgttatttcccagtctccttggaaaccaaagcttgggcaagctgatgcttgatgaggaatatccgaatggccttctcttggcggccttgtctgcttgacaaaataccgcacctgaaatattttaagctaatgttccttacagtgtgctttttcagaccactgcatctaatcactctgaacaagtatttaaaatgtggaccactatgtccagaggatgagatggttggatggcatcaccaactcagtggacatgagtttgagcaaactctgggagatagtaaaggacaggggaacctggcatgctgcagtccttgaggtcgcagagttggacatgacttagtgactgaacaacaacaagacccaaggcaattcttaagagcagtaaagtctgagagggcctgctctcaatttatggcttcccaggtggtgctagctggagtctgtgtagaatgactttcctaagcagagaggaaatggggtatctgaaagaacacgggggtagcagaagggacctgagaccagtggaacttgccatatctccctaatggagccacagagggagccaaatgggacctggagaatgggaaaatattttccattaaccaactgatgtatgatgttactcacttgtatttttatcccaattccaagaatctaaatatagaattcccatttggtgcttccaaaagaagaccacgtggtctaatgatgtttgtgacaaagggcatcattcatgagagtctcatccattcattcattaacaaatatttgttaagtgtcaattatttgccagggactgcactggcataaatgagtaaaaaaaaaaaaaaagcggtaacatctcctgccttcttgagcacatagagggctccaaagtaaccaaggacaaagaagagacaaggagaaacttgaagctcccaagagcctggagctaggaaaggaccttaatggacacagttccttcactgaactggtgagaagacaaagactcgaaaagatggaagagtcctgtgtcaccaagtgtcacgggagctacaaaggcacttgtttctcagttcgtagaactctttctaccttgtctgtttcacgccttcctgcaccaagaaaagcaaaggagcaaaacaaatactgagttgccttttctccatgtcattagagtgagtcatttgaattgaaggcgacaaaattcttcccacttaatgcaacacttttaaatgttcatttttcattcaattttaaaacagcctacaacacagcatgcagagtgggatctcgttcttgtaaacagtctatctgcggtgtgtatgtgtgcagagaaaaatggctgtacaaatcaaaggttatcaatagatactcctcaggggctagaattaggggtgcttttatattttctcctttatattcctagaactttctcaggattttctaaatcttccacaatgaacacaaatcacttctgtaatgaataaaaacgtcatttcaacaataaggtttggttctgtgtttaagtcacaagatttcccttttggggactaaatcgattctcatgaaaggtttccagaatctttttgtccagaaaataactaaaaattaaactcagtgttggtatcccaacagaagagaccaggcacatatggtcacctattgacaggactcctctgggctgttccttggatgtgtctgggcaaagattcagtgtatgtagtcttgaatgcaatcaactcttctacaagtatttcccgagcccttccaagttcaaagaactgcactgtgccttgtgcataaaacgcgtaagacatgatttcagtcttcaagaaactcagggtttagctgaggaatgaaggcgcaaatgtatacaaactttagtaacaaaacatgaacaacaaagcgatattggaaaatacactgtgtgtgtgtgttgttttttaacacaagttctttttaagtggttttttttaatttatttatttttggccgtgccgggtctttgttgctgcatggtcttttctatagttgtgttttttctctagagcaggggccgctctccagtttcagagcaaggacttcttgtggtgtggtggcttctctcgtggagccagactctagggcagaagctcaacagttgtggcgtgggggcgtagttgctctgcagcatgtggaatctccccagatcagggatggaacccatgtctcctgcactggcaggtggattctttcccactgagccaccagggaagccctacactgtgtgttgaaccaagagggcagtttcttccagaagccaagtggcagagaggagatgaaggacaatgggaagccgtggtggatttttagcagggaggtggtgtaagatttgtgtttcaggaatactaaggtctgtgcaaggcacgaccatttttgaacggggagactgaggagagggaagaaaacaaaagcaaaagcagtcaagtgaaaagaaggctaagtttggggtttcagcctctaacaaagcaaccttgaacatgtcacgttactagattcctcacctgccaagcgagacagcaggactaaactctccaaggtcctttgcagctgtcaacattctttagttccaccacccaggcaagaatgatagaggcccgaatgagggtgtttctgtggtgagggcatgaacagttttactccagtaaatgcctcacaaagggagtggctagttcatcttcagcacagacaccagaaaaaaaaaaaagaaaacagatcagatttttgacccccttacccttatttttaaccccttaggaggtttgacaacaaatcttctctttcttctttttttaaaaaaattgagatataatttatataccatgaaattcaccatttattttaaaggatacaatttagtgggctgtagtatattcataaagttgtgtgcaactatcaccactatctaatttccagaacattttcatcacctgcaaagaagatatctggagacttccgtggtggtccagtggttaagaatccgccttgccatgaaggggacgtgggttcaatccctgatgaaggaactaagagcccacatgcggcggggcagctaagcccatgtatcccgcaactactgaaccagcatgctccggagcctgagagccacaactggaaagccagttgtgtgctgcaatgaaagatcccgcatgacacagcaagactccaagtgcagcaactaagacccaacacagccaaagaaagaaagaaagaaagaagcacttccctagaggtccaatggttaagactctgcactaccattgcaggggggatgggtttgatccctgctcggggaactaagatctgcacagcatgactaaaaggaaagaaagaaatcccatactcatcagcagtcactccccatttcctctcccccagaccctaacaaccaccaacctgccttctgtctacagatttgtctcttcgtggacatttcacataaatggaatcataccatctgtggctttccgtgtctggcttctctcactcagcacgctgttctcaaggcctaccctgtggtcacaagtgtcagtacttcattccctttttaaggctaaatactattttgttgttgggagatgctacattttatctatctattcatccaccagcagacatctgggttgtttccacttttcagcagtgcactgaatcatacatacccttgtttatcagaggtaaaattgtcacatagcttccactatttgaattttaaaagaagtggaaattttgggtggagggagcatagtcaattctggatggagacaaaacccacttcatctgcggtaaccgttgcagacacctctccgacaagcttttccatagatactgcaggggtaaacaacatatttgtatctccaaagagggtgtgacttcaagcaaaaatttttgagcagcaaagcccattccatggatttaaaaatgccacaggattaggggataatcttagctttcatgctctgccaatgagaaggcattgagtttggacctccccaggcatgacagaagccaagtctcagcctaggtgtgacctgccctttggtctgtaaatagccaatccagacccttgcctatctgagtttcaacataacttttcctttcccagagtccaagtttcctcactgtatctttatgagctggaaaaacatgaactgtcactgaaccgtcaatgttcatgtcacattataagacccaagatatctttgtcttttcctagatcaaactgaaattttataagtccaacaaaacatttatcaggttggcatgagacctctaagttcaggccttcttaaatgggatggagagggtggggggggtgaggggggtcagctgcatgttttcttcctctggtcatttaatataatttttcaattatcacatggaccccctcaaaaaaaacaatggagagtcttaaggttgacagctttatcctcaaggaaaaaaaaaacatttactgagcacctactttgtgccaggaagagtggtaaattccacagtctcttgtaatccaggtgaaaaccattaaaaattcaccataatttgccagaggctgatggggacagagaatggggaggtattgctgaggtattgctggattagcattctgactaatttcttttctgactgagtgaaaatgttcctagatcagatacagtagcgatagacgcacagaggcaaagcagccgcctgcagtgcaaaagactcaggagacgcaggttccatctctgggtctgaaagatcccctggagaaggaaacggcaacccgctccagtattcttgcctaggaaatcccatggacacaggagcctggtgggctacggtccagggggtcgcaaaaagtcggatacaactgaacacgtgtctcatcggtaaatatactaaaaattactcgggtgtacatttaaaaagggtacatgaattttatggtatttaaactatatctcaataaaatttaaaactgagatagtaataatgccccaccactgtgttacaaagaagactgagaaaaccacgccggggggtagaatagaacataggttttcttttaaatctgtagtaaatttccctgtatccttgtcaacttgcccaaatttcccaaagccctcctctgctgctgctgctgctgctgctgctaagtcgcttcagtcgtgtccgactctgtgtgacccccatagatggcagcccatgaggctcctctgtccctgggattctccaggcaagagtactggagtgggttgccatttccttctccaaaagccctcctccagctgttcccaatccccaactttccgtggttcagtggacaccccctgttcacagactttggtggaagttctcttaactgcattgcacccgagaatgtctcgagagaacgctgcctgacttacaaagtgatttggaaatatgctgctggctgtgttttacgcattgtatcaagtgtttctaactttgtactggctgggaccatgaagggcacagttttcaaaggttgaagttaataatttcacaccagaaaatgatcaactgggaccgcggagcagcaagctgcctgagttgcgatattcctgagtcctggaggcagcctcacctctagaggtgacacagtggccactggtcggctttgaggctggttgatgtagtagttgagcccagggtttcttggagacaagccaactgtgacgtaatcacaggtatgttaattaagctctctaaaacctcagtttcctcatctgtaaaaagggatagataacctataggtttttgagaagactcaataaaatgcctgggcttcccaggtggcgctagtggtaaagaactcgcttgccaatgcaggagacagatgagacactggttcgatccctgagttgggaagatcctctggaggagggaatggcaacccactccagtattcctgcctggagaatcccacggacagaggagcctggtcagaaagagttggacatgactgaagtgacatcacacacacacacacacacacacacactaaaatgcaccactgacaaagtggtgactgctattagagagctgttgcttttcaactgtcctttaggaaggcagatgttcacctcatctgaggaccctcaaggaggctggcaacccggctgggtatattctgattgtcttccctcttaaacatatcacattctaaaataaggcagctaaggagcatgggtccgtggataccctgggggaactcggtcaacattccacgatggaaccaacaaaccaggtttccacattcgccatttggactcccctgatagctcagtcggtaaagaatctgcctgcaatgcaggagactccggttcgattcctgggtcaggaagatccactggagaagggataggctacccactcctgtattcttgggcttcctttgtggctcagctggtaaagaatccacccaggagacctgggttcaattcctgggttgggaagatctcctgaagaagggaaaggttatcctggcctggagaatcccatggactgtatagtccatggggtcgcaaagagtcagacaagaccgagcaactttcactcacttcacttagacttgaagctatttaagctcaagggcccactcctcccaggttgtcaaagggtggtaccagagagtctgtcagaaccacatggagtgtttgtttaacaaaggtcgttcccaggctctcccttcacctgcgcctccggagagggaaccggcctgacaacagctcctcgcagcctcttctgcatgctggatttgagaatgctgagcttctgtcgtccaagtgcctacaaccgtcaatgtttagcacacagcaggtgcttaagacattctttcttaataaatagaaagtgaaggtgttagttgctcagttgtgtccggctctttgtgacccccatggactgcagcccactgggctcctctgtccacgaattctccaggcaagaatactggagcaggttgtcattcccttctccaggggatcttccccacccagggatcaaacccaggtgtccagtactgcaggcagattctttaccatctgagctaccagggacacaataacattaaataatattaacagaaaaaagttaaaggctaagtagaaatcatgaatgagtgaatgaatgagacagtcatgtgtatccagcttattcgcttcttctcactacattgtccctaatggggaaaccaccaacgtttattgaaggaattttcccccagtacaaaagcaatatatgattgatgcttaaaacttagaaaataagaaaagcaccaaagaaaagatgaacaagtgataactatctttgggtatatttgtgtgaggccttctggcttttttaaaaataattttatgtagttagttatttttggctatactggatcttcattgacacgtgcaggctttctccagttgcgatgctcaggcttctcgttatggtggcttctcaacttggagaccacaggctctaagcagctgtggcctgagcatagttgccacaccgcatgtggggtcttcctggaccatggattgcactggtgtcccctgcactgcaaggcagactcttaaccactggaccaccagggaactctctttctggctttttgtatgatgcatataagtgtgtgtttaccaaaaatatcatcatgttgtacaccgaatactcttttcagccggctttttttaacttagcaatgcattatgaatatgttctcagcttagggattcttcctcaccataattttaaatggcagcaaggtattctttcaaactgtggtgttggagaagatgcttgagagtcctttaaactgcaagggcatcaaaccagtcagtactaaaggaagtcaaccctgaatattcattggaaggactgatgctgaagctgaagctccagtactttgaccacctgatgagaagagctgactcattggaaaagaccatgatattgggaaagactgaagacaagaagagaagggtacgacagaggatgagatggttggatggcatcaccaaattgatggacatgagtttgagcaaactccgggagatagtgaaggacagggaagcctggtgtgctgcagtccatgggattgcaaagagttggacacgatttagcaactgaacaataaaataatcttaaatggcagcaaggtattctatctagacatactacagtttatgtaatctctatgtggtcattgaacattcgagctcaataattaatttaaaataaaatgtacatgaatactccaattcacgtcttcagtggacatctgtacttttctaaatttcacagctgatttcaatcagcagccaggactgatggctcccaccatgagaggctatttctaggatgttctctcaggaaacctctggagttggaacacaaataaggaaaatttccatgcctcaagaatgtcagcaaacctggcttacaagaactctgttaattccaggaggcatagttctgtcacagatcacaagaagaaagaacctttgtgttcttgtcatcatcacaagtggaccagtttgacccagtgccaccaaaagggtatcagatttatttctggtaaacaaccactttgagaactatacagtgatactctgccaactggaatgatttatttttatcatttctttccctttcgttgcttcgattagttgccaagatatgaaaggaggagcttgctgcctcttaggagctcagatatagaagggattcctacagatgtaaagatctaaagattaaagaaagcccagagtttataaaaatcatgttgcaatttagtttatttgatttttagcccaatacccataccaatgtcttctccaatatgtataacaaaagtgaaagtgaagttgctcagtcgtgtccaactctttgcgaccccatggactgtagcctaccaggctccccgatccatgggatttttccaggcaagagtactggagtgggttgccatttccttctccaggggatcttcccgacccagagatggaagcccagtctcttgcactgcagacagatagatgctttaccttctgagccaccggggaagccccatgtataacaaagggaaggtcattttttaaaaagttaaaacctgggagttcctgggtggtctagtggttaggatttagcactttcattgctgtggcctgggttcagttcctggttgggaaactgagatccagcaagctgcacagcatggccaaaactcttttagaaataaaaagtgaaaaactgattccaagggaactggcaagctccttgaaggcagagtctgtcttggttgcttcattccctggagcatcttgatctctagcatgaggctaatgttaaatgagttaatgcccgaaagaatgaatgtggacatggtcctcttcaagccatacagtataaatgatcagaactattcagtgttcctgcagattggccttaatctccaaagatcacccagcaataactccccccatggctgaaaactcaaaaaatgtagtgtttttatttgcctcacaattcgaaggacagaatcaaaaccccacacaaatatgtcaccagtctccccccaggaggtactgtcaattgatataataataataacgcaagatgctgcaagtaagagtttatttgcagccttatgaactgcaattcagggggttaccccagaagcttagtagcaaagaatctacctcccaatacaggagacctgggctcgatccctggtccaggaagatcccacgtgcctcagagcaactaaccccatgtaccataactactggagtctgtgctctagagcccgggagccacaattactgcgcccatgtgctacaattactaaagcctgctcaccctagagcccgtgttgcccaataagagaaatccctgcaatagaagcccgtgcaccacaaccagagactggcccccaccctctgcaactagagaaagcccatgcagcaacagggaggacccagtacagcccaaaacaaggaaataaatgctttctttaaaaaataactgcaattcaggagtcatggattcaggttactaagaaagtgttctggggaacagaaaaaagttgcctggagagaattatgattgattctgatacaaatcagaaaacatctgtccttaaggaatcacagtctgttttagggcttccttggtggctcagacggtaaagaacctgcctgcagtgcaggagacctgggaagatcccctggaggagaacatggaaacccactccagttcttgcctggagaatccccatgggcaggggaccctagtgggctacagtccatggggtcacagagagtcagacatgactgagtgactaagcacagcacaggggtctgataagtagacaggctgccatgagcttcgggtagatgttctggatgacttgattaagtcaaaggtcagattccatccagggtaagacgtccataggtcaccctctttggtggcctcccgtttcatttcaaagagctctcttagcaataccaactccattttgatcttcctttcccagtacccaattagccaaatgaaaagtctcggtattccttatcactttcggggcacaagggctatctgcaaggtcacattaattcatttgctacagagacagtggcaggtgggggaaaaagcctcctttattctcaagtcacatcatccatgccgttcccaggcgctcagctccatgagattggctgcaacctctgggctgaccactgttctccatcttccttcactaaagcgcatcgtcccaaacagagctccagcctgacttaccaggaacctcaaggcaagcgttcctccctgtgtgcttctttattgataaaaacgacagagtggttagtctgccactagggctcatcaccactttcttgggaggtgcatcccattgtgggatccgggataatcccatctctcctacggggcattctgaaatctgactacatcacacactgacccatgttctaggagggcttctcctcctgtctatatacgcttcattccctgattttatttttccttttactatgtttatttttccttttacgatcactgtgttaatcgctcaatcgtgtccaactctttgcaaccccatggactgtagcccaccaggctcctctgtctgtggaattctccaggcacgactattggagtgggttgctacttccttctccaagggatcttcccgacccaggaatgaaacctgggtctcctgcattgcaggcagattctttaccatctgagctacaagtaattgtgggaaaaaaaaaaatatatgtatatatattgccagtatgtatatatatatacatacatatacatataatctttttctttatcatataatttctttttcacaccaaactcctacaaagccttcactgttcccacatttttactcacaccagatatatatatactcctttttttctaaaaggaagcagtactcatttctttcttgtttaccagcgtatcctgagagttggatgttttaaaaccacaaatctggcttctctgtgacctcccagatgaggagacaggttgagacacaccagctgtggcccctccctctgcaggccagctccttcgagaagggcctggttttgacaagaaccatttcccagctttcagaagccatgatgaagctctgctccgctgttctggaccaccactcaagaaggagatgaaaataagaattaaaatcccataatgaaggataacccagcttgggacttcctggaagtcctgtgtcgagaatctgccttccaacgcaggggccgcaggttcaatccctggtcggggaactaagattccacgtcctttggggacaactaagcctgaataccacactggagaagccacagagaagactcaatacagcaaaaaacaaacaaacaaacaaaaaagaatgactcgagtctgtgctcctcctgcctccatagagagactgtatttagagaaacgatcttgagaaagagaggaaccgctcaagttcatggcgcattgccttgatgctagcacttggtcagaccctcctcaggcattcagtcacatgacctgtatgattcctgcccccattctccaggtgaggaaactgaggcacagagctggtgactggcagggctgggatgccagccccaggcagtggggctgcagagtgcggcactaccatcgcagccccagcagataacgaccaaaccacggggacccaagggacccctcccccctcacctctaccccccactcccagcccccgtcctcgcccaccaccaccttagtccccagagcccccccgcaggatcaccaaacagaagcaagcagggagctgaagatcacttccttacatccgaaaggcccccaacatgcattgtttactgtggtcactggtctcctcagattacaggtggcatttttatctaatcaacggacagaagaatgctttccattgatcatttgctcattcctgtcgtcattaccatctcccagaacagggcacccactgaatggtataacctgtctctgaaccgacccagacccagaaagaaaaagggactttgataagaaggacttaggtggggccgtcttcggtggttccgtggttagcactccacacttcccagtgcaggggaaacgagtttgagccctggtcggggaactaagatctcacatgccacccagcacggtccaaaatactaaataaataaattttctatttatttatttaaaaaaaagacaaagatccgctctagcccagaggcgacgttctcctggatctgtggtggcaaatgtcaaacctgcctggggaagcgtcaggactgagaaggaaccaaggccagctgcaaagagcattggagggtgggggcccctggggaatgcagagactggctcccccaccaggctctgtgacaagaacaagaaactgtacctgtctaagccccgaaacacaaggagcccggattagagcatcactcagaagtcagttcatgagtcaatctcataatactctgattcacgcttgcttgtgtgagcggtgacacggaggtttgaatggcgaaagctctagaaaaaagtgatgccaaggccagaggcggaattgacaatgtgaggagatggcgccccccagtgtcaagatgatgccttggaaacctaggtcaggccgagcatcacccgtgaccttgagcgccgagtaggtgatgcttcaagataggcgcaaccacccgcggcccaggagaggcccagggaagatgcctgtggccagggagggggaccgcttcccgcagtacctggttcgcctcagtcaccgtctggatcccctttgtgtgctgcggacccacctaaagcaaccttctccaaagactcgaaaataccaccaagccgtatttatgtttgttggtttgtttttatggttttgccatacatccacatgagtcagccgtgggtgtacatcctgtacacctgtacatcaggttccccatcctgacccgccctcccacctcactttctctgtagtagatgcatcggatcccaaggataaaaagtttaaaatcatatggccgcagcacctggggtcccattgtccactttctgcaacactttttcttgcccaaagccaagtcaattccagcccaggggcctctgcccattgacaggactcctctcagacccctttaacgccatagacatgcgtagagagctgccagaggcacgttcccattctcaaggtttaagtggaaaaacaagctacatatggagttctaaattggggctgccaacctgggcccccaagacagcaagtggctctggtctgctgtaaaggatccatgtacagttctcaaaataaactcggaggggaaaagaactaaaagagagaaaaaactgatgcgaagttcagtccaagataaacatccaaatgatgcaaacatttcctaggtcctttcagtgtaagaaaatgcatggggacaatcttaacaccctttgctctgaagataccatccttagatacattgtgcaaaactgaagaacaggttccctgggctgggggagtctagttgaagttaacctggggaagaaaacttagaaatcctttggtctaactttggagcccggtccttcctggaactcatcaacttgaacttcaccctacaggtcagaagctgagcgttgtcagaaactagagtgggtgggtctctccttcatggggcaaatcgttaagggacaggaccatggccccccctctttgttccttctgattatgatagcaacacatgctcagtatagaaaaaacagagaatgtagtttggaatttttccctcggtgtcattaaatatgtttctatgccactaaatactttttgaaaatctcgtggtaatggttgtacagtgttccattttaaaaaccattctcttatgctcagacatttgtttccaattttttgtcattttaaactgagcgcagtgaacgtgctgcccattaacctttatccagatttctgagtttcagaaggttctttcttgggtcaaggggaaaaatcacttcattttttttacacatgtgcaactgagggtctcatgacaccatgctgctgtctttcatgtcagcatatggtgcctttgcagagaaaataaaatggtgacaaatgtttgttttgaattgaaagtcagcatgaaacaaaaaagctgagatttgatgtctgggtttcaccaccgctagagccccagactatgaccttgggcaagtcactttaactccatcagcctcagctgttaaaataactatcttaaatttaagtttgtacaggaggaaagagcctaaaaataaagtgctaagtcgtttccgttcttctacgggacaaaattcttttcttctttcaaattctctactcttgcacagaagaaggtttgacattgccgcagttgggaaattgctgtcagatggtacctggtgggggcttcccaggtggcgctagtggtaaagaacctgcctgccattgcagaagatgtaagagactcgagtttgatccccgagttgggaagagccctggagatgggcatggcaacccactccagtattcttgcctggagaatcccatggacagaggagcctggcgggctacagtccacagggtcacaaagcatcggacacgaatgaagtgacttagcacccatggtacctggtgagaatttgcttctgagaccctggtcggtcgttgctgggctttgtctgctgtgagaattcagcagacgcccaggaatctaagagcagtgtagggcggtttgactgcagaggcatcaggttcagagttctttctgtgtttctccacttgtcacatcatcaagatggaagcagcatacactggcatcaaaatcccatgccgagactgggacttccctggtggtccagtggttggaactccaagcttccaatgcagggagcctgggttcaatccctagttggggaactaagatcccacatgcttcacatggccaaaaaaaaaaaaatcttatgcccagaagtacatcctgagacccagagctgccatttcctagacgagctgcctaaacaggatccagaaagtttcagcacatataaagtaggggagcggtaccagactcccttcatcttagagttatcctgaactctgggatttctttgaaagggaatgatgctaaagctgaaactccagtactgtgtccaccttatgcgaagagttgactcattggaaaagactctgatgctgggagggattgggggcaggaggagaaggggatgacagaggatgagatgactggatggcatcactgactcgatggacatgagtctgagtgaactccgggagttggtgatggacagggaggcctggcgtgctgcgattcatggtgtcgcaaagagttggacacgactgagcgactgaactgaactgaactgaacttcaaaataaaaatgaaaccatacacatgcagccacttgataaacccttaaattcaaatgaccacaaactactattttagcaacatacaaagggctgaagtgagatggggataaatgcaaaggagacagagggaatctccctgttgctatgcaaccttatagcttactcataattaattaccaatgccataatttagagtttttcaaatatagttagtcccagaacttttgacttgaagtacatctaataaggcccatacattagaaaacatggccttggggtttggttccaggtagaacttaagacctgtgaaggcaagcagtttgtcctgtaccctgctgtacctccaggcatagaagagctgcctgcacttaatgttgttgctgttgttgagtccctcagtcatatccgactctttgtgaccgcatggactatagcccacggggctcctctgtccatgggattcttcagcaagaatcctggagtggattgccatttccttctgcaggggattttcctgacctgggaatcgaacttgtgtctcctgcatgggcaggcagattctttaccactgagtcataggtgctcaataaaacgttctgcataacgaatacaccttcccttagacttatttgaaaacagcctcccagaagaatttgcagagggaagtaaaacaagggtttttttgcactgctagtgaaagtgtaaagtggttaaaagttttgaaaagagcatgccctcattcatcaaagactttttaaattatttacttgcttatttggacgcatcaggtctcagttgcagcatgcagcatctttggcctgggggactagttgaggctttcaaactcttagctgctgcccatgggatctagtaccttgtcaaatccaggacctttgcatcaagagtgcagagtcctagccattggaccaccaggaaattccctcatcaaagacttttaaagtgttcataccctctcaccaagttgtgccatctctggaaatctacttggaagttatcctaagtatgaagaaaaaaaagtttgtgtctaaagatgctcaggagatgaagtactgttttaaaaggggggaaaaaggcaaccatctgaattatgttcaaaagttattgaattattacatcacagaatatccacttgatgggtgaaaatcttataactaagaaatacgattatatcatgctggaagcatgtatttatgaaccatatataatttagtacacttttttcttgtattaaggaaaaaggcaagatactaaattatacatactgtgagtccgtatatgtgataaaaacaaaagcaaaataaagagcattattgagtgctagtcggtcagaaaattgttctatatcttgttcatttttcctaaaagcctgtaaggtaggtgctattataatactcacagataacaacactgaaacacagagaaattatataactgggtaaaggtcaatgaaaggactgggattctagcctgggcagttcaggctactctctgaaaaaataatgggagacaacacactaaaatattgacaatggctgccctcaggtggtccaaaagagagcaagtacattccttctacttttccgcattttaacaagttttttgtaatgatgagaaaactgcactcatcattaaaatcaatgacttttcacataaattaatgacttaataattataatgataagatatataattcatatataataatatataatttaatgttatattatatataatagatacataattatagtaaaactgagcagaaaaacaccttaattgaccatagggccccattactgcaacccagaaactccaaccatgctccgactgcaaactctcttccttacagaaaagaaaaatgacaagtccaagttcgatgcatgaaacagggcactcaaagccagtgcactgggacaatccagagggatgggatggggagggtggtgggagggggggttccggatgggggacacatgtacacctatggctgattcatgttaatgtagggcaaaaccaccacaatattgtaaagtaattagcctccaaataaaataaattaattaattttaaaaataagtttaaaaaattagtgttctttttatgggggaaatgggttgaaaataggttgtttttatgaatgcagagaaactagccaaagctagtgttggattctcagtttcaatgtcacactttactcaaacaccagttctatttttaggtctgcttctcagctaattactctgccctacccagaaggaagtatttaatcaccagaacctcacgcgtccgcacaaaccaagggggtcaatgttgtactcaggaagatggggtggactggggatggcggtcagccggagcagtcacggtccgagtattagggtccgcggcttgagctgcaaagctgcatatacagcatatacagactgcaaggacctgcacttgatacacactttggcgcggtaggaagaaagagtaaacatgctaattgtgctagtgatgaatgtgaaacacaacaaatgccaccctacttatccaaatgggaagttaaaactaggggcaataactctattctacactaagggccagtaagtaactcaacaatctcatttccagatgctctccgagccctctagcctccacccccaccagctctgaggaccactcgcttctgaggactacaactcccagcctgagggagatccccgggcatgcggcctgacgacctacgcctacatttcccagcaggccgagcggctacgctgacgcacgcgtgcgctctctgtctctctcgcagactcgggtttgacctacagctgccaggagaagatggccgcgctagcagtgtccgggctgtcccagcaggtgagaggacggaggtcctgaaagccagcgggaagagccctcccggagtgaccagcactggacccccaagccccacggttccaggccacacctggggagcgtagcggccgttcaaggtcgtgcggtcgggagagtgggggcaacgctgggcggccctgtttccccccaccccttcttccacgggatgcacgcgggacacagtggacgctgcacgctcgtttctaaccttggcgtcctctgagcacagccccgggaaggagctggttgagagacccaggagaagggggacctatctttattgttgtgattaaacgactactagtattactgggtcaacagtaatcctaaagaatatttgtaaaacgtgtttcacatttttatgaagaaaatgaggttggaaagtttaaatgactggtttttgactaagtaagggtagaactgagattcgaacccacagagtcacagaaaaatttgtgctctttatgttatacgatgctttatatatatcataacaccttgtaccttccgtaaattttccctaagtgttatataaagtcttttagccctctcagctgtatagtacactctggaattatttgaaggtggaattatttgaaggtgacctatacccttgcgggtgctttttaaactctggattccaactcttgatagacaagataccatttcaacaatatcaaggttagtatcttggtaggaaacaagctagagaattcatctttatcttcagatagcttttggagtcttaagaaggtacctctctcgcagataatgcctggaatcgtcccacttgttactggaatcgtgctccacgatggtaacataaatgctggaaatcttgtcaatttttttttttaagactgacttctgaaacttgggcttccctggtggctcagtggtaaagaacctgcctgccaatacaggagacatgggttccatccctgggtggggaagatcccctggaaaagggagtggctacccactccagtattctcacagcgggggaatcctagggacagaagagcctggtgggccgcagtccatggggctggagaaaagtcacacacaactgagcaactaaatgtttctcaaatttagtgtttcctctcccttactcgtgagccagcctcacagtgggaaggcagttttcccatgcagcctgtaatgactcttcagtggggaaatttactcctgggtgatgaagagcagctcagcctcataaaatctatgtgttgatataaggaaacataagaagtgaaccatttactattttttactatcagtaacctcattcagtctttctgtttttgtgttaaaggtgcgatgcttcagtacatctgtggtcaggccatttgccaagcttgtgagggtatgtcagcttatttttctgtaattgtaaagcaaataaatgtatgtggtttcagacaacaatacatttaggcatggattttgtacagttaacacttaaatctttctgcatgatttgtggttccccagacatgctggggagtaggggagctagggaacaggatagtgttgaatgcctgtcatagaccaggcccacgaaaaaaccttttaagttggagaatttcttaaaacacagtaacagtgatgggaggtagctggtcttcccattttacagaagaggaggggttattcagcttagtctctgagctggacagaaactaaatcttgctcattaaaaacctaagcttttccagtacaatcacacagtaccactaagcatatgtagtcatacattgatgatactgtggtttaaaaagcctgtggttcactgtaaaaaataattgaagcatcaggcacttagtaaattgctaaagggctccattaaactgaacatttatggagatactctaagggaaatttgcagtattgctatgaaatgtataaaattgtgcttgtatgtgtctcataaacacctgttttccagctttaacgtgttcaaaactgccttctatcagtgtttaacaccgcctaaacttggaactaagtagttactggattcgaaggaatcctaagtttatctcaaaattagcacggttgaattttctgtagaatggaaagggactttagacaccatgttttctaagcccctcattttaagaagaggaattgaaagctcatagatggagtgacatggccaaggaaacatcccctatttgtttgagaattgtcattcagggtagcattttacaataattttaaaattataaatatttctgctcttgataccatgatatggtcttaactgattttccttttctcttcttgccttactccaccgttgtttaaagccacctgttcagatatatggcatcgaaggccgctacgccacagctctgtattccgctgcatctaaacagaataaactggagcaagtagagaaggagttgttgcgagtaggagtaagtagctttcctgttcattattaagttctcactgtatgttttttccttagatctttgactgtgcatccttaatgaagtatatcctaagagaaaaagaattgcaaaaaaagggaaagaagaaaacatttcctgtaaccacgttgatagttataatactgggtaaaattgttctgaacctatttataataggtatatgtaagaatgttaatgttaggaaccgagatttggggctcaagagaagaaatagaaaatctaaattttaagaaacaactgccatttcaaaggagggttaaaaattaccttgagcatttatgcttgtattactcggtatttccaaagtagtcttcaggatatattatgaccttgttttgctgggaatttattttccttctgaagtcttttcctcagcgtcagttgtcattttattcccaagatgtgagggaaagtgagcagagcccactggaccgcacattagtgaaggtgcccgagctgcaggacgatgacagaacgacggaggaagaccaggagactgcgggggaagctgatttgtatttttttgtaaacatgaagagtacatgaactgagttaacaggagcctgcagtgtggcttaaacaggaggatggccactgcaggttccctgagtcgtctgatagttaacaagtcgctccagattttgttgcttccccttcttttactttctagtcgccacctagagtttgtttttgtgtttttaatcttagaaggggaaaaccctcacagactagctgtatagaacaatacttaggcgttttgtgcattttttcattttgagcttttgtgggagcctttgtcctaacgctcagtaactctagctctgtatccctccctctgtccagttatccagtgcgcttgatcttcgctggtaccctcacctgttaggatgttcacagatccagcagcctgacttggagatgcttctgggctggggtagctggagtctacagggtcgcacaggcttttggggaggtgatggttcctgccctctgctgtcatgcacacccctcgtaaacctgtgatgttcacaagcaagacagtgcctggcttgtgggccttagaatggggtttaattaaaactgaagtccgttaagctgtggagacatacgaaacaaaatcagccattttttggcgccaggaggaaaacgtgatgctgccagggtgtcgctaacggtccgtggatgatgcagcagaaatggttagagacctgaaactgggatggctccagttccagaatgcttgtcgtcgtataagccagcagtgtgtatgggaaaaccttgttttgggggggtcactcgagttgaagttttaacattagatggcagtgtaggcacgtagctagaatcagaggcagaaattgtccaggagcccaggagaggggttgatcgaaaggtcagtggaggtgtgtgaccaagagatacccacatggaaacagcagttggtttgctggagctctggcttgacgctgaggggagcagagtgctggaagctgcccgtggtcccggacttgacgtttgtgatgtagtgggacggcgacagagtcgcctctcttgtggtcgtggagacagagtcgcctctcttgtggtcttggcactctgaattttttggccgtttttcctcccaggaaaagcaccagagctcccacccagcagtgggttggttttccggagctctgggcagctggccggaatccggatcagccttagagggagaggcccccgagggaaaggccaaggggccgcccgcactcagtgcgtctcgttaggtctgcgttgtgtgtgggcatcactgcaccctcttagcagggaaaaaccagagtaatacccacagtagatacattacagtatgccacagatccagtctcatggctgcttagttttttaaaaataatctctcctgaaaagcaaaaatcaacttcattagaatggtcttaaatattttcacacaataccatatcctgtgtaaaatcatctgtggtgcattcttaaaggcaaaaatttatttgactaaacttttctaattttattcatgaaatgcatgattcatcagaaagcgtgtgtacagcagctggcatcatttatgttctagagtctaagattatttttggtccttttagcaaatcttgaaggaacccaaaatggctgcttctcttttgaatccctatgtaaagcgttcagttaaagtgaaaagcctaagtgacatgacggcaaaggagaagttctctcctctcacgtccaacctgatcagtaagtattagctcttttattgaagtctctgaaaattctgctcctgaaactgtgatccctggaccaggaacaccaccagcctttggcagtgcagagtctcattacccgaacctgctaaaccagaatctgcatcttcactggcccccgagtgagtcgcttgcacatgcagtttgaggagcactgtcggaaggacgttaagatgcaggagtgtctcaatgcgtagtttcaccccttggaggaggccagtgggatccctgccgagaaagtggtttacagccagtggctgcgtctctgtccttaaagacatttgcattctttggtacattttaattgtttttcaaatcccttgatcactcagaatccaaagaaaatgtgtactgaatataagtatgttaatttggggattcgtggtataaacctgaaaatcagatttcaagctgtgatgaagaaatctattgcagattcgtttaagagacacacccctttacacatttaagtcctcgttggtgcattcttttaaaaaaaaaaattgaatattctttttagataacaggttgcagcttctccatccacatccttaactgacattgaatatagtattttaaggccatgtcagtttgcgtttgaggtgaatatactgcttcacgaatatgacttaagtgaaaaatgttcactttcccagatttgcttgctgaaaatggtcgcttgactaatacccctgcggtgatttccgcattttctaccatgatgagtgtccaccgtggagaagtaccatgcacagttaccactgcatctgtaagtaatgagttgttgccactgcattgtcttgactttccattttgtagaacaaaaagaaaaaggctaaaatcaagaaatcggggagcctggcatgctgcagtccatggggttgcagagagtcagacacaactgagcaactgaactgaactgtcagttgggaggtctcttcatttataccagcttctgtgaacatggcaacccactccagtattctttcctggaaaatcccatggacagaggagtctgatcggctacagtctgtggggtcacaaagagctggacacagctgagcaacttcacttcccttctgtgaacctctgcttcacaaggcctggcaggtgtctccctggtgcttccctattcagtggttattcgtgaagactgtaggttgggttaaaatgtgtcaggaaatactggtttatattccagtacaggtttgaattattttttaaacatcatgctcagtagtttactcaaatgtaatctgttcatcttttgtggtgatgaagcagaaagtataaggcgaacgggccccattggtcttagggacttgctgaagtagagtataataatagtcaccatttattgaaatacaatgtgctgggcactttataatttttttacttaatgtcaaaggtctgcgtgaagcagaagtgttgttacccttattttactaatgaggaaaccaaagcccagggaaagtaagttgcttgctggaggtcacagaaggtggagctgggatttgaaccacagtcctgtcttccagtagtccatgctccttaagtggcactgcctcgctggaatgagtttcattgttgtccagtgtacagtggagtacattgtatttcccttgtattctctttgcactgtagttcattgtaggagaacagtctgttgggcttagttacctaccaagcatggtagagttacttggggtatgtagcacctgatcttacctagatgagtgtttgtagtgcttcagagattctgactctccaagagcgtaaccaacggtgctcctgtgaggcgggctttcacacgcccgagaccagcgccgatgagtgcctcttggggtgcgactccagagtgggtccccagataccgagcacaggaattcacacagcctgtcttggtgaaatgttcccagagggagatttttctctcctactgtagtaacttgttttactttacctgaatttaaggatgttttgtccttttttaggctttagatgaagccactctgactgaattgaaaacggtcctgaagagcttcctaagtaaaggccaggttttgaagttagaagttaaggtaggtttttaattgtgtacagtacatttcctgaggttgtttggcacttaaaatggactggaaagtgagagcagattatgtaaaactgcctatagtagaacctttatgtttattttcaaaatagactattactgaatccattcacaatttgacttctttttccagatgtaattattacatgttacaatagacttttcagagcacttttttttatcttgctttttcattaatgaaatgtcagcgtattttcacatttccaacctattttctttcctagattgatccgtcgatcatgggtggaatgattgtccgtattggagagaaatacgttgatatgtctgcaaaaaccaagattcagaagctgagcagagcaatgcgggagattctgtaaaagtgttgattttctaaaagtgagaattcttaaacttggagcaacaataaacacttcctgaacagggcacactgtgtttactgccttttaaagcggaagtgcagggagccttagtttttatctttctctcaggatccccttaaaggttaaaatgccctttgaaatttagtttttgtccattgttctaagaaattggatgcttatatatcccttaggggaaaatagccttcatagcaggcgctattaagttcttcacgtgtcttacctcatccctttgtctctgagtccagagcctgggcaggggctgagcctgcaggtgaagttaaggtcgtcatctctttgagtttttcggctgttggtttcatcttgattcagaactggaagtggcctcagcccacgctggtcaaacgccggccgctgctccttctctgccactttgtgctgctcacagcctctgcagcatgtgggccgagcccctcggccgtgcccccaaggccacgtacccgccacacgcctgggctgcttagccgtccaaacagggccggtttgtgctcacccgagtattctgacgggtccatatgtccagcctgtgcgttctgacgagccgaaagtgatccgtcctccactccactctccatgtaattctaagttcagaggcggtgatgtctataaaagcttccagagagattctggccaaaaacacatgtctcttctggaatcgagagaatctaattaaaagcagtgactgctatcactggggcagaggtccaggtgagagccgtgcactcagcaggcggcaggtttctcagctcgccgggcgccacagcccttggagtgtcctctgaaccaaggatgcctgggaatgtcagcccaggacagagtcaggacttttcccctcttgggcacaccagttccagtacactgatggttagaagtcactgctcttgggtcgagcttctgcccgttgtgtgtgtgtgagtcgctaagtcatgtccgactgtttgtgaccccatggactgtaacccaccaggctcctcagtccatgcagttctccaggcaagaatcctggagtgggttgccatttcctcctccagggcatctcccccacccagggattgaacccaggtctccggcattgcgggcagattcttgaccatccgattggttctgccagttaaggccttcccagccaggttgggggagccaagcacacagcaaactttcctgcttctctgagggttaacagtcaccctgaaattgccagaagataacatttcaagagacaacctgatgcatactcagccaccacacgtcaggtcataggacatcctgacgggactagaaggcttgtggccacaataagcctttctccgcgtttctcccagactgaaagtgacctcgccaggagtaacaagcactctagaaccgttcagcaggaggttccataaggggatatgacgtgcacccacagtgcgccccctgactagactgttctgctctgcagcagtaggcgtgagggttaaggacgcgtcttagagctgtctgggggtgcacatgcaggcctctgctgtttcaatccctaaagcctcctgctttgggggatcaacttccaccccgtacgtggaagaagctgtaacatccacttggtgagtaactgctgcaagagtgaagcgaggtcatgatgagttcagtactgggtctcccagatgtaaagatgtcggtgaagggtgttggtccctggcctgacagcctctgattttgggccatctgaccccagggattggctgactggcttcacacagcacctgacaggaggtaggcactagaccaagtccatctagaatcgcctgcaaaatctcccatcttcaaggatgttcagaaatcctgttcagaaaacctgttcagaaatcctggtttctaatagaccattagggtgactgactcgatcagtcccctaggaaaagctccccagtaaaatgcccttaatttggacctaatacccgcaaactgaaggctgctctgtggtttccaagactgcttcatgttacatcttaaatatttaagcttcagatggctcagacaggaaagaatctgcctgcaagccaggagatgtgcgtttgattcctgtgttgggaagatcccctggagaaggaaatggcaatccactccagtattcttgcctggagaatcccacggacaggaacctggtgggctacagtccatggagatcgccaagagtcagacacgagcgagacagacctcactctgcaagtgagggaagaaatggaggtttgctcagggcccccgcccccagcctcccctgtattgtgtttgttcctgtttgcccctggccactccctggcacgtggtgcacccgcactggagccagcaggcaacactgagctcaggtgactctctgggcccctcgcacttggtcccttagacactcttgattcgccctttaagccaggccagctcttccctgagcttgccctcctactggcctcagagggaagagcactgtccggacagcagccacctcaggtgcccattccttggtcacctccaagtgtttggacagcgaacagattcccttcccagagccacccgtcatgggcagaggcagggctgtgccatctaggaagtcctcagggcactgaggggcccggggccaccccctgcaccttgggcagggaccagtgtgcctccacctgatgtgacgtcaccctcctggctatcacagtgctgaaacgaacttcctcctggcaaagcagctccaccatcagcacgtgcaatggacagagacaccactgcaggcctctccgtcctctcccaggagccaggagggctcaggctggcctgtggccccaggatccagccacctagctgcggacatttgccaacttccctggcgattcctggtgctggagctactaagttccggcagatgaaaagagaggaaaagtgtcccttcccaactggcctcacgaggaccgggctcgcagttccctttccctctcactagatgtggacgcagtggaaagtgcagcttttacctctttacttcaaggtaaaagtcaaatgatcgcaaggccctgccaggccagacctcggacctctgggctattaacaagagggagaagaaacctcccactgacgccacgggagggtggtctctaagggctcagcagctgcgcctgtaacgcagccaacactgctggttccccaagaccatctgccttccttccggcttgcctcctgacaggggttgcacaccgcacacccgaggcagaccacaagctttgaagacgtgtaacagctgatgaaatatctctgccggtaatactgcccaatccagaatccaactcaacaaactccttgttgattaagcacatagaaacggggggagggaagtgatgaaatgcttcaaacactgccttgtgtgctcatcagagatgaacccagagatctgtgtacagtgacagtcttcatggcactttttttaaatctagataaaaattttaaagcagcctcaacacacaaccattcaggattctttttaaaacatagggtaaattggaatatattcaagcaatgggatattatgcagttcttaaaaatcaagatgttcaaaaacagatagatagatgacagatacagctgtatagtggagaaggaaatggcaacccactccattcttgcctggagaatcccatggacaaaggagcctggcgggccacagtccatggggtcaccaagagttggacacgacttaacaactgaacaaccaaacagtctgctcagaaaggaagaggggcagaaagaacccaaagcaatccattgtaacaaggttggtttttctccttttattcatgaactatgtgaatttaaaccgtacaggtcaaaatgaccaaagaattgtttggaagagattgttcttttagattccagatacacagaaatatccatctgtattgatgttgctactggtttaaagaaaacaacactcagttaccataatcttgatcagtcaaatttaacatttcttacataataaggtgccaaaggaatgctcagagagcaaacctaaccttagcttcttttaaacagaaaagaaacctaatgtcttggccctgcttcatcaaacaaatacagaattctacaatttataatagtgtctagtaatttttggaactccattgacattacacaccaaacaatatagtctccctttgatgggaaattaaacaataccgttatttggcaacagaagtatattacagttaacagggtgtccgtcggggaggtggagtggctcatcccaccccccgggcagggctgtgaggggagcaacatgcccccaacactgtgacccatctgctgctggaaacacaagggactcgtgtcaggaccgatacattcttttctaaataggtgaaggctaactggaatggtcactgctgagcaggacgccacgttctctggcttttcttgaccccagactttattggaacaagcaggacccaagggatggttgactggctgactcatctccacgtatagccctcttgccacaccagccatgaggacttggtgccaaggaaggaggtcaggacttactctgggtgggtcgataggagcttatccacttctgctggctagctttagatggccttcccaggccaccttggacaaagaggtccctaaacagctccatgtttggaaaagaagtcactcacatccacccagacagttcctcaaggtgattttcagatcactcctatgataacagattccacgaagctcccagaaatcacagctccctgcgccccctgaaccctgaattccaggaggtcacttacacgccagcatttgccaatttgaggtgtatcaaaaaaggacttggactgttggttgacagcattgggaagcatacagctcattgaaagaaatgttgaaaacctaaggcacgcattccctatacgtcctttcaagccagggccctcagcgtcccacacacagcgatctgtatgcaacacccgtggctcaccaggaacatggcttttttcaccgctccatcgttcccagcctgacgagggaggctgacctgacagcgttgcctcctcctgaaaggacctctaaacgcacctctcgggggtttgcatcttgagtttcataggattttgcgttgtatccatccttaggtggcctgtggggacatttccggtggcaaaggatacaaagtctgtgcccgagaagcagcctggacctctgacccttttctgggacagggcaaagaggaaggcctcttgctttgaggtctccatcatggacacaagcagctagaaggctgctctgtgctgcctgtcctgtgtgccaggaacagcttaacccagaaagccccaaacttcatccttcacccaacacaggagagccacagtggggatagtgaggatgcctccaggaaaggaaaatgcaaacaccaaagggatgcattgaatctattcagaaagagaactgcaaagggtgacccagaagtcaggacattcggaactttctagaagaacgattgctccacccaagattcctggcccatcctccagaacctatggaagcttccagagcacatcactcagatctgatgggaaccagactctcaagcctcctatccttcctgacacaagcaccttcccgaacaagttacctgtttaatgaaatacaggggtctcacccaaggtcatggctagaggacactcatcatcttatcataacaccacccgttgcattcaacttcacattttctttgcccctccaaaatgacttctttgaatgtctaacatatgcaactctggttttctttttaatatatgaaatttagttgggtcgaacccaagtaatctgattaagcactctctactcttggaataggttttttaactttttctatagttttatgcacttaaattagattcctaaaatactctcatatacatacagaaaaataatctctcaatgacaaatcacattttacaataacaagtcaattatttataactacagaatctgcattagtttatgcaacacttaacagcatcacctcttacacaccatatgtacattgagtcatagacattcccataaacttacggcagagatttctggacaaaccattgaaagagcataactttttccactttacgtagtggaattctgcatttttcttagctgcaaactatataaaatgcagaaaaccaagagctgaggactgcttatcatacacgggacattctgttgcagactctcatctgtatacatgtatttacacatatgctaaccacctatagatgtgaagatatacgctgatgtagctaaggcaacaggacatgaattatgagatcgccaacttctctgtccaggtaggactatgaaagggtagagaaagggcccaaagggtacagatctcagcctgcttgggcttcagcaaagaagatctgaagttggttttacagtttaaagacacttgggctattggcaatgtacattttaaatgcatgtgttaaaataattatcgttaccaaagatcttgctagaatatctactgtctgatactgaatatttaccagacaacattttaagatgttgatttgtacaatgtacaacaaaatgttcactcgtgaaaactaacactgacacaatattaattaaatgcctctagaaaacactttctgaactttcagtagtccggatgattgcaatacaagtagaaacaaagctataatttgttatttcattcaaaatgacacaaccaaacccatgcaagatgaatttgatatctctattcaactttctgtcagtatttttacttagcaaactttataatcccagacagaatcaggaaacatagacaggattattgctctgtgtaggtagacgtgaaactgatttgcaaaggtcaagcaaaggttttggagtgtcctgctaagcgctagaaagtgctagtgaaagaaagtaagacccagcacacagggggaggggcgactcccgtgtcagctgcctccctggcagctggtcttctagaacccgaggctactcacacagtggggtctctcctcccgtcagccccctcataggcgggatcctatggcagacaccccaactgggaagtagctgcatctcagtagcaggtacctgcagacacctgtgtacccagcacccagcctgggcaggcttcactctctccaggaagaggagatggaggagcagcatccagccccggggaaggggcaccgggcaccacccacccccaccagctccctgcttcttgttgccatcactcagatggtcacttggaaggcagaggctagaggagcctgtctgatccacaagcaaagaggagaaaagcccccagtggacgactaaaaggaagggttttatttccgatcagtgggttaaatggtaaggacttggaggactctcggcacccgtggcccgccctggactgggagcccacagaccaggttcatctgtcatcttggggcttgagtccttcacctctgactgatccagatcatttgtgcttttaaaagcagacattttgaaaagtgttaccagcccagttctccacagcctgccagggagactttgcaaagtaagaagcagaaggtgaagccccacctgcttcagaaaccaactgaaaagacagtgaccagggccggcttcgtgggcgtctgatctgtgcagtcacgggggaccctgtgcttaggaggacccgctcctggtttcattctctgctgtcatcaccttgaaattcttcacaattctcaacaaggggcctcaccgtttcattttgcactcagcccacgaattctgcagcgggtcctgaccttgactgcaggaagagtcagacccacctgttcacatatccactcgttccccctggtgcacacgcaagcacacacacgcgcacacgcacacaccatgcaatgatctgcattgcccccctcagctccttgacatctgaaatcccaaatgttatagtctccacctagaaactctgcgatccagtctaagcagaggggacctgacttctccaaccccttgttggggtgcctcctccccatggacccgccgcggctcggcccagcagtaggcggaacacctccaacttaacacctgaagcccctgcagggctgaatctcaaagaggccttcaccaaagcagatgcagaaaaagcataagggctgaggaccccttatgaccccagccccgacagcagagaaaggcaaggtgtcaccaagtaccgcaggagtgctggcttcgaatcccaggctcgccgctaagctccctccctcaccaccctgctcagacccagcaagttccttccgatttgcacaagagcatgggctgccgtctaaggggtcgcacagagtcggacacgactgcagcgacttagcagcagcagcagcagcaatgcccggggagctgcactaggcggagccatcggcctgagatccgccagtgggaccggctagtttccaacgccggggagcgcgcctcctagcggtgacagtgggtagaacggcaggggctggctcctcaaccagactcggcaaagctaccatcccccctgcccctggttcctgcatcaccctctctgccccaggcccctattctgtttagactgagaaacaggaggaaatcagggctttgagtatgagagggaaaatgcaaaggaacatagctttagaaacagccgcacaggaatgttattctttttcagtgaaaaaagtacaaaaccagagttcctagaagaaaaatatgcattctttccactgcataaaaagaaaccctggttactgggtaagttctcagtaaatatcagagagagaagtgctcgattattttcaaggctgaccacatatgcccacttctgaacaggtttatttggtgggctttgaatcctaaaatagtcacacatttctgatgattttaacaatataggctggtatagaaagtagaacaaaatcgttttaaaaaatgactcacaaaacaccctgacatatactaggggcaaatttaccctgaaatctgacaaccacacatagtgttgaaaaaaaattattatgtgggtgttatctggttccccgaggccagattaaagagggttcctttcagtgcaggaacgaattgaaactgcatgtcactgaaataatttttggaggtggaggtgagttcttacaagcactgggtgttattcaaatgacttaaaatagatctacaatgatgttgtgaaagccacaaaggcagaccccctcctcaccacctcccagccccttggatagtggtcggacccaggaaaggggactccctgaatgaacaatgtattattaacattactgacagtgttaccaagaggtcacaacccagggataagacttgccagctgttggcatctgggttttaatactcccgagatagggtgctgttagaagttttctatctttcatgcaggatgaattttccaggcttattaggaatagattttggctcccaaaggtagcagattatgtaccttagttgagcctggagacctacgaagatattcctggatctgacacaatgcagggtgaggaagtgaaagttctagaatgttcctttcctctagctcaaagaaatggctgctttccaagtgcaataaacatcccaaccatactgacacagtactaagcggcccccataaaacatggctctgggcactgccagctgagtcttggcagctgacctgagccataccctgcagccaggagaagccgctgggtgcaaaaagaggacagttttagtttaaccaaataccctttagggtgactcagaccacagcatctgagggcttcaccatgtccccagttcaccaatcatgcttctgctgggtaagaattaaagtcctaatcctaaaagccagtcaagaatatccagcctcctctgtcgtcattgcctcactttcctgcgcaggaggctctgaacttgtaaagcaagggcacctggagcaggcagaccccatgctaagctcacactagcctcaagtctgaagtgaccctgccacctcgaaagcacacaggggtccatttctacatgccagtgtctgctgtaaagctcgtctccagccccaaaaagaagggaaaatacaatgaactgacatagaatgaaaatctacttgctgttcccagtggaaattcttaaaactgttacatgcacaaaagaaacatcctttctgtgaaccaaaaaagcccaaccagcgagggaaaaaaccgtctggagtagagagaagtctttttctgcttctcaaagtacaggcaggtggtgctagcggtaaagaatctgctgcagtgtaggagacccaggttcgatccctgggtcgggaagatcccctggagaagggaatggctacccactccagtattcttgcctggaaaattccatggacagagaagcctggtgggctacagtccatggggtcacaaagagtcggacatgactgagcgactttcactttcacagtattggcgaaactctaaaatagactcccagatctccttccggataaaaccagaagcatttcactccctccctttgctttgttgtccagccccactggattctagaacacccccactctgctgtagtcagtggctttatgcttgcaccagtctactcctggagagacaggagtttggggtaccaggtcaccaagacaatgcaagtggtaatttactcatttttggatggattttttctccattaaattcgatagtactaaccagctgaaatgagttaccttcctagacttaggtcatgcttaaattgttccaaacgcaaagaaaagaaataattccccttttaacatgaacattccttggaagcatagctctctcctctgccatcagaggtcagggacatgtaggatgcctggccccagtctctcaagcacatctggataccccagcctagaaagatctgtgtgtgtgcatgtttgagtgtgtgtgcctgaggccagccctgaatctgaatgaaccacatcctcaggctctggtgggagggtcacagctgctctggttccaggagacatgttgcccacctgcctgacagaaagaccctgccccagagggactgggagagctggttgacaaaggaggcccagcccaagggctcctgtcctcagggcacgtctctgttagcagttcccttgctgggcttagacgaggtcagtgtggctcagagaaggaagaaactcaggatgtctggagggctggagtcaatgccagaagggagtggccaggggaaaccctgtgtgtggaaagcaaagagctaggacacagaaggtgtcatttcatctctatgaaatacagccccggctgcccaaaaaggtagacgcgaaggactagtctcaaagaactggagactccatgcgtcatccacattcctgagtcacagctgtatctgacaggcagcctatctcatccgtaaggaggatcagtcaccttacaaatcagcctgatgagtacaagggcactcatccagaatcgctgccccggaggagcatcgcaagggtgctcagtacagtcacctgggagaaaagactcacatattgcttcttcatgcgacattaattccgataatgggactctgcatgggtgggtgagctggtggaccaaaaaaaggcgacaagatgtttgtcactgagcgcatcacatccaccctacgtgaatggtgatgcccaacatccacacgcaaagaaagccaatgaagaaaaggaaggaagaaaggcattgctctggtgacccaatatgactccgtgcacacaggtaacccttctttttctaccatagtcacgtatcctccataaagacactgaacaaactgtattgggtatagacataggaaagtgtgactggtaggtctattcataggtttcacttaaaacggtttcctaacagcatcgaaacatacatatacacttaaagtatccgaaccatgcttgctgctggaaagtggtaaatgaatgcatgcttgaagttgaacttggtctctaaggtcttcagctgagagttactaactaaagggtagatctgcttgtttcaaaaaatacttatgtctgttgttcttgatacaaaagtctacactatctttaataaataaataataaagtgtatcttaaaagtatgaaatgtaaactttgttgccctttccgacacatacattttaaaaattgcttgaatgatgacagagctcttatgggaaaggatgacatgacacattcggttcccagcaaagtgggtagttcactatcttttttttttttttttccctcttttttggccacaccatttggcacgcaggatcttagtttcccaaccagggctggaacctgcacccccagcagtggaagaacagtcttaaccactggaaccaccagggaagtgccaatgctatctttagaatgcatttctacaatcctaattaaattctaaggacctacaatcaaggagaacaccgtctcacccaggaaagctagattccaggactgagagaacatgcaatgaacatttcatgaaaaaacgacaaactgggactatgggagcattaacatgcaaacaaagaacgatccacgcttgccacgagcaaatcaattcttacctagtcaaccagcctatctcctggcatttaaggagaaaaactgaaagaactcaaactggcattactcagccacaaaaaggaacggaactgtggccgtttgcagagatgtggatggacctagagactgtcagatagagtgaagtcagagagagaaaaacaagtgtcatatattagcatatatatgcggcatctagaaaagcagtatcgatgatcttatgtgataaagacatagagaacagatgggtggataccgagggagaaggaggcgggggggtgggcggtagattgggagagtgggactgacatatatttatacactaccatggataaaatgggtgactagtgagagcctactgcacaccacaaggagctccactcagagctctgcggcgacctaaatgggaaggaaacccagagaagaggggacatatgaatatgcatggatgattgactttgctgtacagcagaaaccgacaccgcagtgtaaaccaactatactccactaacaatttgaaaaacaaaaaactcaaaccgaacttggcacatggtcatacactcctaattctggcatcacgctgtgcatccttccgttactgagaggttggctgtgtacggcgggctttgggaaggagtctcaggtctccttccctggaaccgaggggcttgcccactcctagcgtctctcccccaccacagtaatagatttcctccgcggattgtcagttttcctttgcacaccttggggacacctttgggaggaacgtaccaaagacacgtgcggaaattgcccatgacaagcaggcaggaagaggctcagagctggtcaccagcaaccactcttgttctgaaacacaggacctccaagcagaaagggaatgtccagcagggctggagatggggacccaataacaccgtcaacagccttcaggtgagctacagcgacctagtcccgcagagtataactaggtagacaacctcccttaaccctcttccaggggtgagggaaaccaggatcaggcctcctggcagtagccagtgatagtttccattgacagctaccaggaaaaagatctggaggagactggaaaaaccctaacaacacgcctgccggaatctaccatggattagaccagcatctgatcggaagaccatctccccaagtgatcagacccagggcagcatttccaatgaggtcccagtggggaaatgagattctgaagcaatgacatcatcagtgggatcatttctaaacacaccaaggactagacatcctggagggcctgcttggaggctggtggaggtaagaagcaggagggtcccatgagttctccaaaaatacagacattgcatttatgaacctattttacagtaacgactcaagcctcaggcccagggacgggcccaccaaacatagttggggggtgatgggacttcaaagaccctagaagccacgatgagccccgcagtgaggacaaaggaaaacacagtgctgtttcctaacatgggaaatgatttaggggaaaggattgtcaagaactttggaggagcctgtcttctctgccctgttgccctgtggccgaacaccaaacgccggtccttgaaaaaccatgctgtttccagacaggcagcatctgctgcctcgggctggagttctgccaagcacgcctgggtgggctccctacggctcatcgaacaactgcaggtccaagcggaccacgatctctcccgtgggaacttcgtgcagcaggagacacttcgtaacgggacccttggagccctggtccttcttgatgtcggccacgcggatctccgtccgacccaaaaaatctgaaaggacagacacacataccctcctcagagaggattccttctcatcagggcaggtacctggcatactgggagtgtcccagcgaggtgttacgctctcttcttcaaaagggagttagtttcttggaatccagggactacagtgacagcatcatttttaaatggagtgaaaacaaaaaggtactgggctggggatgaagaagagtctagaagaaactcaaaatacagattttttccttgcacccagggggcccctaaagggccaggagcttcctgggaggcaacgcaaaaccagatatcatatctgctgtgcaatttgcaatatatatgaaatttaaagaaatctcccaggagaaagtcagttgtttctttttttctctcttcacttatttatctggtggggaggagatgatagcacaggagctgcgggctcccagccgagctcctaggacaatctcaacaccactatttctcttatttttggctataccatgcagcatgtgggatctttgttccccaaccaaggatcaaatccacaccccctgcatttgaagcccagagtcttaaccactggacctccagggaagtccttcaacaccacttttcgtcaaatatcgagtgtcagggacttcccgggtggtcccatggttagcgtgcagaccttccactgtagaaggcacaggttgatcttttgtttgggaactaagatcctgcatgccgcatggcaggatcaaaaaaaattatatatatatatatatatatatatatatatagagagagagagagagagagagagagagtcagtaatggacatgagaatgtttgaaatttttttaacgctatgcattaaaatgatggtaccaaatgggcttccagacaattccttgcttttttttcattcagcagttggcaatatactatgatacaggcactcttgtacaggaaatagcttctctttcaaggtttaaaacctgggaactttttctggtggacgataccagtgcatatcgccccttgtacatttcaggaataacctctgacacaagagctacactagggtttgcaacagaaactctagtggcgctgccactgtgtcatgatatttcactatttaataaaagaatccagcctaggtctttatttatcagaataaaaattgccagtgaagcaccatggttaagagtccagacttgagtcacactgttcttagttcagttcagtcgctcagtcatgtctgactctttgcgacaccgtggaccacggcacgccaggcctccctgtccatcaccaactcccggagtttagtcaaattcacgtccatagagtcggtgatgccatccaaccatctcatcctctgtcgtccccttctcctcctgccttcaatctttctcagcatcaaggtctttcccaatgagtcagttcttcgcatcaggtggccaaagtattggagcttcagcttcagcatcagtccttccaatgaatattcaggactgatttcctttaggaaggactggttggatctccttgcagtccaagggactctcaagagtcttctccaacaccacagttcaaaagcatcaattctttgacactcagcgttctttatagtccaactctcacgtccatacatgactactggaaaaaccatagctttgactagacagatatttgtgggcaaagtaatgtctctgctttttaatatgctatttagtttagtcataagttttcttccaaggagcaagtatcttttaatttcattcctgcagtcaccatctgcagcgattttggagcccaggaaaataaagtctgccactgtttccattgtttccccatctatttgccatgaagtgatgggaccagatgccataatcttagttttctgaatgttgagtttttaagccaacttttcactctcctctttcactttcatcaagaggctccttagttcttctttgctttctgccctaacggtcatgtcatctgcatatcctgaggttattgatatttttcctggtaatcttgatgccagcttgtgcttcatccagactggaatttgtcatgatgtactctgcatataagttaaataatcagggtgacaatatatagccttgacgtactcctttccctatttggaaccagtctgttgttccatgtccagttctaactgttgcttcctgacctgcatataggtttctcaagaggcaggtcaggtggtctggtattcccatctcttgaagaattttccacagtttgttgtgatccacatagtcaaaggctttggcataaatcaataaagcagaaatagatgtttttctggaactctcttgcttttttgactatccaatggatgttggcaatttgatccaactgccttttgttcctctgccttttctaaatccagtttgaacatctggaaattcatggttcacatactgttgaagcccggcttggagaattttgaacattagtttgctagcgtatgagatgagtgcaattgtgcggtagtttgagcattctttggcattgcctttctttgggattggaatgaaaactgaccttttccagtcctgtggccactactgagttttccaaatttgctggcatgttgagtgcagtactttcacagcctcatctttgaagatttgaaatagctccactggaattccatcacctccactagctttgttcatagtgatgtttcccgaggcccacttgacttcgcattccaggatgtctggctctaggtgagtcatcataccatcgtgattatctgggtcatgaagatcttttttgtatagctcttctgtgtattcttgccacctcttcttaatatcttctgcttctattaggtccataccatttctgtcctttattgagcccatctttgcatgaaatctttccttggtagagtgaatgtggtcatgctctaacacttagccagctatgtgaccatctctggcccataattaatagtaactaactcacaatgaactaattcatatgaaagtcctataaaagacaaaagccacatggagcaatttaagcctcgcacagatcatgtctgcattggaccctcactcctagccctcagttatcctcccttgaatataatcaagttgaggccataatctttaaccttactctcttatttttattggactgaggaagatagagacaagtgtcttggaatcgttggccagacccattttttttttccagcttcaagcagtaataggaagttgactgaaggaatgatgcacccaacataatttcattcctttgattaagctgaaatgtcacccgaagggcattgatgaattctgccacattgttcgtgcgctaatgctcttcttgctcaactggatagttttatcgttttcaccaaagcttttagccaaggactaaagaattaggctgaagctttgggggtacagccctctctgcagttatctgctttagggaagcatgggaccatgatctttgtcctagggaagctggaccactctagaccaagcacgctttgtccaccttctctgaaatgctctggcatcagtgaaggccttttcccaggggaggccaacctcatctctccagcaggaagcccaggaaattctgcacagcaagttcccaggtagaaaatgccaatccatgaaagccaaggggcagggacaggggcagggtgcccagggccactgtctactcaccatctggcgagaactggtccctctcaaacacagtgatgcacagcacctcctgctccaggtctctgatgaagaactggcagttggaattccacttgggattcagagtgtcctggatcgtcttggtgatgtgacactgggagcccatggtcacctcacagtacgggttactctttcctggaggggacagagcctggctgttctgggtgcctgtggcagggccacagccccgtggcacctcttccctctacacccctcattccaacccccctccaatgccatgcttaagatgcagcataagatagagaatccagaggaaaaattacataatccagcatcttaaactatattaacacttaaatatttatcacactttatcacataagtgggcttcaaaactaaatcttccttgtctcctcactttagcttagattgtgtcaaatctgcaatcatccctcagtatctacagggattgggtcctcaaccccacagatacacaaatcctcagaggctcaagtcctttatataaaatggtctagcataaacctgcccatatcctccacccacttgaaatcatctccaggttatatataatacctaaatcagtgtagggctgtgctaagtcactcagtcgtgtccgactctgtgcgacgccatggactgtagcccaccaggttcctctgcccatgggattctccagggaagaagactggagtggactgccatgcttagtctccaggagatcttcctgagtcagggagcgaacccatgtctcttctgtctcctgcactggcaggcaggttctttaccactagcaccacctgggaagcccatggacagcagagcctggaggctacagtccatgggattgcagagttagacacgactgagcagctgagcacacacacagataactgctttacaatgttatgtcagcttctactgtacagcaaagtgaatcagttacttgtataggcaatggcaccccactccagtactcttgcctggaaaatccacggacggaggagcctggaaggctgcagtccatggggtcgctaggagtcagacacaactgagcaacttctttcacttttcactttcatgcactggagaaggaaatggcaacccactccagtgttcttgcctggagaatcccagggacaggggagcctggtgggctgccgtctatggggtcacacagagttggacatgactgaagcgacttagcatagcatagcatcccctctttggatttccttcccacttagcttaccacagagtgttgagtcctcctggctttaaaacaaattggcccctaatcctaaatttccttccacactgggttattcccatccactgttttgccttacagagagatctgagtggctgccctctgacaacacagtcaacccctctgcagattcaaccgactgcagagcgaaaacattcaaaaaatggaaatacagtgaaattcctatgtaaatagttgctggtgtgtggcaaattgaagttttgctgttttgaaatttcaaaaatgtttccaaatattttcgttctgcagttagttgaatctgcaggtgtggaatctacagatacaaggggggctgacagtgttgtgaaaaggcagccactcagctctctctgaaaagcaaaacggtggatgggaataaccaagtctggaaggaaatttaggattagggaccaatttgttttagagccaggtggactcaaccctctgtggtaacctaaatgggaaggaaagccaaagaagaggggataaatgtattcatgtaactgattcactttgctgtgcagtagaaactaacataacattgtaaagcaattatctgtgtgtgtgctcagtcatgtccaactctttgcaaccccatggaccgtagcctccaggctcctctgcccatgggatttcccaggcaagaatattgggttaccatttccttctccaggggatcttcccgacccagggatagagcccacatttcctgtctcctgaattagctggtggattctttaccactgagccaactggaaagcccctaaagcaactatcctccagtaaaaattaattttagaaaataaagtaaagccaagtggaggagatacagcaaaggcttcccccactcacacaggctagacggggcttctagggcccttaccatgggagcgacagggtttcagctcaatgccttcaaccacgttcaccatcaaccttccgatgcctgtggctctttgggagcggactgtgatgggatgaaaaacaacacaaaacgctcctgtttagcgttcgcggtatttccagtttgcctcgtgatttattttatgcccctcttcaagaacaagtctccccttcctcccttaaactcttgcttcctcgatcctggaatccgccctccacgcctcaccccataccctaccctccctcttctgcctgcctccaccctcaggctctcctcaacccccaggtccaccttccagctctaagggttctgggcctggccagatggctctctgccccccaactctgcgggattcccagggccctgctgcccagctatgcgttacccaggtacgccttctcccgcttcttcttctctgtctctatgtagagttcagacgctgctttgattttctgcacccaggcagtccttggaaagaaagagacagaactcaggcgtcaggtcggtaccaattcagtttccaggactctgctttgttcttttgatttttacaacaaaggctcagcatagagagtctggttttatgtcacatggacctaaggatgatttctaccattcataacaaaggcacacgtgacgtttttattgatttgctccaaacctgggtttgtgtccccatggaagcaaatctacagtgataaacgctgttgctgtcgtgctcacaacagctcctcttctttccttactgaaaaacatcacaaatttgcctaatccgagaaggctagaaggatctctctcactaaaccatccaaagaaagaaacaatttcccagataagcagccactttctgtgaaggagcaaacgtacacggggaaagcatcctggcgtgattttgttcttttccatttctctgagaaccatatgcatgataactttagcccatttcttgcttggcacaaacgctcttggaatgttgttggtcttgtgtcaagttcacccttcataaaaatactctgtttcattaggctccagggcagagccctgattaaggcaaacatgccctcagcttctaggatccaggatgtctgtccaagggagccagacatcaagggggtcaggattgggaggtcttctatcccccaaatcattttcctattagtttctgccacgtgggaaactttgggaaatgggagagcctccattatctcaaagaatactgaaaattgctgttcaaaaaaattctcaagccaggttcatttcaatgtatttccttttgaaaagttaacttctgaaagacgctggaaaaatgaactaagaccacttcactgcatgcccacccccacctccagccagatgggatggcgctgcaagtgaggggatgttggcacccactgattaattaactgtcccacatccatcctacacctagtggaacccaggtgcccagggccagggaggagtggggtcttacctttcatttatgctctctgctcggagggtgtagactcggtcaatgtgggaaatgtggaagatgggctcatccccagaagggtcagtgggcaacttcactagaacctcatttaggaaaataggctgcaaaataatgcacgggcattacaaaaccagactgggggtctgtgaggacgtgtgtgtgcttaggtgcacgtgatccagtaaacgaaactgaaggtgaggggtgtgtccgtttgtgtctggggggtggtggtggtttcagtaaaccatactaaaataatgattttatttggaatgataagcgactcattggaaaagaccctgatgctgggaaagattgagggcagaaggagaagggaatgacagaggatgagatggttggatggcatcactgactcaatggacatgagtttgggtaaattctgggagttggtgatggacagggaagcctggcgtgctgcagtccatggggttgcaaagagtcagacatgactgagcgactgaactgaactgaataagtgttgatatcaattttcagataaatggaaattgtaaatatggattcccccccacctccattctgcaggtactttttttccctcatctggctaaggtattatttcccaggtttctacttgtgaatttttatttttacttccccacttttcatactgaagtctttagaaggaagtcgatatgggcagcagcctacacttaaggagtactctgctacaaacatcgacatacaaggttttatgcaaagataagttttcaaatgagttgcagaagtactagagtgatcagtaacctggatggtattgcaggtatttctaaagtcctccagaataagaaccgatgagtttgttttttccatggtatatcctagtcagcaaacaatctccatcaactttagatgtattatgcatttagaaagtgttagtcgctcagtcgtatctgactctttgcgaccccatggactgcagcacgccaggcttccctgtccatcaccaactcctggagcctactcaaactcatgtccattgagttggtgatgccatccaacatctcagcctctgtcatccccacagcctgccaggctcctctgtccattgaattctccaggcaagaatactggagtgggtagccattcccttctccaggggatcttcctgaaccaagaatcaaatccaggtctcctgcatttgcagatggattgtttaccatctgagccaccagggaagcccccatcaactctacctccaagcaactcctgccaagttgttcatacaaagctgctagtgacaatctacataagtacattgttctttttcccaaaagaaggctaactgctgcttcagagaaaattcttctgtgaaaacacccccacagagataaatttagaaaaacaataccctatgacacgaaaacacacaaacacagtcatacacacagaagcagaccaaataaacagctcacgaaaactgtccacacatggactatttacatcggcttttgttggaaaacatgaggggcacagatgttccaagccatcttgagaagtttggagggggatctgggaatgtttgggaagtggacgctgaagttctagtctagagctttcccacgcctgcctcatcagtacagcggactgtgaaccccatcaagacaggacatgccttagtcacatccaaggggacccacagcagccgcttggcagctaatagatgtttgtcaattgaactgagtattgttctttttctgatgggttcccatggtggctcagtggtaaagaatccacctgccaagcaggagacatggggtccattcctgggcctggagaaggaaatggcaacccactccaatattcttttctgggacatcccatggacacaggagcctggcaggctatagttcattagatctcaaagagtcagacacagctgaccaactcatcacacacgcacctttgctgataactgctggacccgtgctcgtggtctccctaaatcctgcctcacctcctctgtgccacagaccccaaagcctgctcgaacgctgactccctttagacatggtctcctccccccagcatcaaacctgatgttgccgtctagagttggacttactgttttgtacattttatactgcaggtttgatttggggctgaagactttgtcggtgcccgaggagcccaggggcttgatgatttgggtcagcagcaggaagtcgttgaagaggaagccatacagctccttgttgctcttggccttgtagagcttcccactgtgcaggaacttgcgcggccccaggcagttggtcacggaattgaacacaagttgctgaggaagggaaacaaaacccaaagaagacacgatggagtgaggtcgtttttttgttgtggttgtatttttgttcgtttgttttttcgcatctgaaagccatgggctccattagaatctgaggcccgtatcttaggctcagatcgaggacggctttgaagacttcaggcaggggctttgggagccaagaagttaaaggcgtggtttgggagactgcatgtgccaggatgaaccctggctgtgattcctagtgcccttccttgaggtctagtgtctcagggtgacttttctcccttttattatcggggaaacagggcagccggaagaaagctctccatcctcgatgagcgcacgctgtgtgcaggctggtccgccaggggcggcatgagccggcgccaaccacggcccacacaggctcaaagggtcgtgcctgctgctggaaacagcgcgcctctctctgcacagttccacaggacaaacgccactgtccagggcacggcgtgagtccaggcccctaccgcatgggtgggctgccaaccgcggtggtgctggcggaggcctcagagccaagcaggacaggagctgtgctggtgcacgttggagctcacccagctcactgctcctgaagacagggaggggacagctctcttcctgccacctcccaaaccttggagacagctctaagcactgaaatgcagctctactgctcacccctgggtgctgtcatccttgctctgtcaccccccgggcactatcatcttatgctctgccatccctctgggctctgccatctcatgttcctacacacacacacacacccccctggttctatcatttcatgctctatcatcccccctgggttctatcatttcccgtgagcaggttctcaaggggcagagggaaactgtagaagatatgacctcactaaggacccccttctggctagtggaggagagactgagggaggggaaggccacagcggtgcctcagaagcaatatgatcgaggcagcagtcagaccttcagggtttccacctgctcacacttgggccccaagagtacactccatccagcaaccttcaaggctgaggctctccgcagctataaaccctacacatgtcctgaggagtattaatgaagagtttacaacacacgtccccccatgttgctggctacctgtctgcctctagtgtggaagaaagaatcaacagtgcctctgtgaccagagacctataggcctcacaggagagaggccactccagtcccctctcaggtacaaggaggaatgagtgcccacaacctcccaccgaggttctgagggagcccgaacaactgaagatgacaccccaaagggagccttctgagagtgggcctctgaacaagagcctggaggtcaatccagtcctttttatttgccaagagggagttcaagccacttggggcaatgaatccagtgagtcacttggatgaggtagaggtggtgtggtttattcttactcaaaggtcagagcctccagttattcaggctgacaccgaacatatgtgaattggaaaccgtctttatagttcttgatcttaagacaagaatgccaaagacagcatttatgtgaaacttaatcactggtgtatgcttagatctgggccaggaaatggaagccaacatgcctcgttcccatgaccacgaaccctgaccatacagacaaaacagaccttacagaaagctggtgtacaatagtcaggaaggactggtcacttaagaaggacaacagtctatttcaaagagggtatatacaccacagaaagcaaatgacaagagtttattttattcttaaggttttgtgggggtgttggctgtgcctcaaggagggtggggtcttagtccccctaaattggtgccccctgcagtggaattatggtgtcctaaccactggccttccagggaagtccctattcttaacgttttataatgaagactcaggcctcactgagtcctgtgactgcagccatgagattcagggaagggcccctttaaaagtacacaatgcggggaattccctagcagtccagtggttgggactttgtgctttcactactggtgcagagttgattccctggttggggaactaagatcctacattctgcatggtgcagccaaaaaaaaaaaagagagagagagaaagaaaaagataagagaacatcttttaaaaaagaaaaagtgcacagtggcccttcagctcagtagatccaggagcagttcaagtccactgtcttcaagatcaccttagtgctcctcggaatgacgcagtgcttccgtgccctgcctgcaacttgccttaaagcctatcgccggtgaccttccactcctcacccacgccccgcacaggctgaggcctccactgaaatgccctcccctggattctttcctggggagatatcttcatccttgaacacgcagccaagtctcaccttctcaacctgtccctgaatcctccacgactgttccttcctcctcgtccagtgtccagcagcacttggcacccagatctgcctcatcatttctcacactgtgctgtaaatgttggatctctaagtgatccaggactgcaggtttcttgagatggggtaggtcacatctcactgattttcatgtcctcatggttggtactgagcagtgtttagtaccaagcaaggcacatgggcccggtgctcagtaagtgctgaataaatgaatgaataacggagccaaccaaccagtgaccacccctggatcgcatatcaacacagttccaaaatgggaactcacatccatcaccttggtttccacatggctgcttccataactgcttatcccacacctacgttgaaggggacaggaggtagggcagggaggtaacagtgcggtaacttcctcaggtagggaatgtctttgatgctcgtaagaggaaaagagtcatggggagtgtgggtaagggagatggtctgcctgggcattttggtaaatcctagtgaattgtgtaagtacatgaatgtgtgtgtgtgtggatgggtgggtgtgtacaaagagagagaacagcagagtggatgcgactaagggaaagattagggtcaagaagaaaatcagatactataagagggtatttctggcagtatcgtggactaaagactgactcaaccaatgaaaaatgttaaaatggaattaaaaaatatagaactgtactttttaaacacaagcaagctggtaaaaataaatataaaagcaaaaacaatttgcagaagcagaaaatggcatggaaatgtgaacccagaaagataaataagcaccaaagctggctttagctttgagagtctttcttaaatctggtgaccctgagcctccattttaaaggctactggggggagaaggagaaaacagatgtatctagtgtctgcatgaggtgagggacataacaagagatcccagaaagctgtatcacagaggaagaatgacaagtaaactcagtagagatgggaatagcaagaaaatttgcttgtttgtgaatttgccttaaccaaccaaccacaaggttggttgtgattactgagaatttgtaaccacaatacagctctcacacaagtttaaaaatggccatttgtgaaaggaacaagacaagaaaaaccagtaggttagagaaataactagaactgctgaaaaggcaaaagaaaacaactgagaacaaaaaataaagaaaagaacggaaattgaaaactcagtagatggcttaaacaacagatcagatgcagctggagagagattagcaaactggaggttgcagaagaggacgattcacgatttctctcgtcctcctcccggctggctgccgagacgcagaggggcggcccaggtcccacccaaggtttacctctgacaagccttcacacagcacgtgggcctggatccactccagtcggtccgagttctccttctcccgcaccccttcattcacctgggagcacagctcctccgccttctccagggcgtgcttcaggtggctgtggtctgggtggttttcaggagtgttttccaggatctacatcggagaacagaagacagtagccttaggcagcgagtaggcctggggttcactgttctggaaggctcgccccagcagagagagggctctgtacagacctttcctagacactgccaacgtttacagctacagctctgagcacccaccttggcaatgacacggagagagaaggccactctttgttggcatgggacccctatgggagcaggggctgccagattatctatacttggggtatgaggagggcagcggctgcagcaagggcagtatcacaccccacatggattcctccaaggagaatcattcttccctgagtccgtgcacagctgcaggcatctgtgtacctatggaacttcatgctagtgggtgcatcagagcaaaggtgcatttttctgaatgaatcattccagaccagcaattaagagttcagttctagagcaagagcttctggattaaaatccctgctctgccactgaccagtcatgatatgggtcagtcacataaatgttctgagcctcattttcttcatatgaaaaatagggatactactagcacctcctttgggcttccctgtagttcagctggtaaagagtctgcctgcaatgcaggagatgctggttcaattcctgagtcaggaagatccactggagaagggataatctacccactccagtattggcttccctggtgggtcagacggtcaagaatctgcctacagtgtgggagacctgagttcgatccttgggttgggaagatcccctagaggagggcatggcaacccactccagtattcttgtctggagaatcccatggacagaagaacctggcaggctacagtccatggggtcacaaagagtcagacacaactaagcaactaaacacagcacacagaacctcctttataaggttgttgggaggactacgtggcttgatacaagaaagcactttgcagagtacctggccctttgatggtgctcccatcagattctcaaaggagtctgaggacactgaaaacagtcctcgtggggaaagacacgaagactgaggaagcatcctaagccactttgcaatgtagtaggggcatgttgagtgtgcacttgctcatgccttatccatatacaggcttccctgatagttcagatggtaaagaatctgcctgcaaggcaggagacataagagatgcaggttcgatccctgggttgggaagatcacctgaggaggaaatggcaacccactccagtattcttgcctggagaatccccatggacagaggagcctggtgggctacagtccatggggtcacagagttggacatgactcagtggttaacactgtccacatataaatagttcaagtgggttttaccctgaataatatctcatccccaaggtatactttggtttaaggtcctaagtaggcactcgatttgggaaaaacacccaatctaggtattgtgagttccccaacttcccttgtggctcagctggtagagtccacctataatgcgggagacctggattccaaccctgggttgggaagatcccccagagaagggaatggctacccactccagtattctggcctagagaattccatggactgtatagaccatggagttgcaaagagtcagacacgactgagcaactttcacaatcatttccaaaccacagctccagctctgggtggatcctggctatacattcaaatccctttgaaaagtcctgaccttaactctgaccatatcaaaatccccaggggtaggactcaggcattggaattttctagagcttcccaggtaattctaacgtacaaccgagtctgaggaccactgctctagatgggaatcccacatagcagattgtgtgagttcattttttttcaaaaatgaaaatagatatattgctttttctcattgtaaaagtactattgtataatgtatgaaagtcagaaaatttataaagttataaagagcctaaaaaaacacctttaattgtgccatcagataataatctcggtctttcctgtccactgacttcccaggtggcgctaatgctaatgaatcctcctgccaatgcaggagacacacaaacacatgttcagtccctgggttgggaagatcccctgaagaagggaatggtaacctgctccagtattcttgcctggagaatcccacggacagaggagcctagcaggctctagtccatgaggacacagagatttggacgtgactgagaatagcatattgaaaagcagagacattactttgccaacaaaggtccgtctagtcaaggctgtggtttttcctgtggtcatgtatggatgtgagagttggactgtgcagaaggctgagcgccaaagaattgatgcttttgaactgtggtgttggagaagactcttgagagtcccttggactgcaagaagatccaaccagtccattctgaaggagatcagccctgggatttctttggaaggaatgatgctaaagctgaaactccagtactttggccacctcatgagaagagttgactcgttggaaaagaccctgatgctgggagggatcaggggcaggaggagaaggggacgacagaggatgagatggctggatggcatcactgacttgatggacgtgagtctgagtgaactctgggagttggtgatggacagggaggcctggcatgctgtgattcatggggttgcgaagagtcggacacgactaagcgactgaactgaactgaactgagcgactaagcacacatacacattctgtttgttaatacattctgcccagatacaaatacatataattttttaagaataaaaattggatcacactgccatactacactaccattttgtactttctttttccccaattcatggcagttatagtatgttatttaatatatatgaattatagatcatcatatgatgatcacttcacatgaatctaaatcataatttaaaaaaattttttattgaagtatatttatcattttctataggattctataatatgttattgtaaggatgagccacaatgcataaaacttcatatttttcagtatttctctgattaattctttagaataaattcctagagatggaaatgctgagccaaagagaacatggagtttgatgtatacatcaccctccaaaggctgaaccagtctaccctccatgagcaaacctgccaacactgtggactcacagtccttccaataaatgcgcacctgtcaagccaaaagcaatatattttcttgtttagttatgcatttctttcattatcagagaatttgaattttgtgtacatttagtgcataagtacattaaatgagaaagctaacatttatgtactgcttagtatgaggcagatagacatagattcattcactcacttaactttctcagaacaccacgcagtaggtactatcaacgcctctattttacagataaaggaattgaggcccagagaggcaagctaagtctcccaaggacacgcagcagtggtacgggagattcggacccaagcagcctggttcctaacaacacatgctttactactattccacactcctctcagagatgcctagttaaagattttacctatttttcttttttatctttttttaaaacctatttttctatcagggtatttgtctttttctttttgagctgtaagaatgctttagatacaaacatacacacatgatctctatatctttcagtatctacttggatacagttaaagtgtttactcagtttatatctgtcctttgtcttttaatgtttgttatattttgttacacggaattttttaagaaaatgtttatgcaaataataatgttcttgatatgcaagattcaaataatacagaatattgagaaccactgtgctgtctcccttctgctttcctgcctcagagggaaacatgcccagagcaaagggcatccctttagatgctccacacacatttaatacccacccagagtttttccaaaatagaccctactgcaggatggcttgtgaggggttttgtctgtttgtttgttttacttaatagcattttctagatatcactccaactaacacataaaagtctctttcatagtacagattcaccactttaagtactctccttaatgaacatctagttgttcccagaagaaagtattttttttcaagttgctgcaactttaactcctttaaagctctgtctttggtgccgtgctaagaatttccccatcttactattataaagaatattttttgcagctttccatctgtatcttgtaacggccaccttttaaaattctgttcttagttttgctagttttccgatcattcttttgggttctcaagggggtggaaatcatgtttctgcaaagaatgataatttgttttttcctttttaatacgtatgcttcttagttcttctcttgtttttgtttttcttcccattgactagatctagaacgcctattttaaaaacttgtttccaacatcaatttgcaactaaatattgtggaaagtaaacaaagttttgaattagtttaatagtaaccatatgttggagaaaaggaaatggtagattgaaagcgtctttcaaaagtaattatttaactcagccaatgtgaccacagtgtactctgtggggtagaaccggggttggactgaggagatgcttacatgagacagaaacttgtgacatataagcagattcagcaaataagtaaatatactgaggataatgagagcaaggcttctcatggagaagggagttatatacatagaaagggggaaggctagaataaattctatgatatcagattagaacaggaactactggtgcgaactcatggcttctaacatatacatatatgatcttaaatatatgtttgtacacttatgtgtatgtaacagtgtgtatggatgtatacacacatatatgtttcccaactctgccactgagagactcaagaggcaacaacacctcggaagcagtgagcacaccagttacagatgtgggtttctaaattcctcactgaaaggaaccagatctaaaacctctctccacaagccagcctccctgtgcttacagaatcacaggctcagagggtgtccaagtctgttcactcactttaaggatgggcacactgaaaccctaatttcttcttttcttttggcattggctttcttgaaatgacaggagaacaacaatcatctaatatcaacatagagtatctcacaatggctttctgaagacaagtggtggaaactgtattcttttctctcttagagcttccctgatggctcagatggtaaagcatctgcctgcagtgcaggagacctgggttcgatccccaggtggggaagatcttctggagaaggaaatggcaacccactccagtatttttgcctggaaaattccatggatggaggagcctgataggctatagtccgtggggtcccaaagagtaggacacgactgagcagcttcactttcttttcacttttctctctttcttattaggaaaaccaaagcatcaagaccctgcctgtattagggaaagaactgacttacaaggtggaagccacgtgtttgtttgcacagctgatgtgtgtattattagctctgttcacaataaacctttctggggcttccctgctggctcagactgtaaagactctgcctgcaatgcaggagacccaggttcaatccctgggttgggaagatcccctggagaagggactggctatgagatccagtattcttgcctggagaatcccacggacagaggagcctggtgggccacagtccatggggatcgcaaagagtcagacacactgagcgactaacactttcacagtaatccagcttttctttcggagttaccatgcagacacctcctacagcctgttggtatacggtttctacacaacagatacccagtgtgttggctgggaacctgcccatgaccccagatcccagacctgctgagatagcattcttctgcttgaaaaggcaaggcagttacttacatttttaatgatcagtgggtatctcgttactcgttgcataggcttcagtataaaactagacaggggcattcccttacagcgtgggtccatggccagtctctgaaaaaaaagatatatatatttttaatgtacttaaaaagtctgcaaaatccggtagtgatatcacaccgttattcatgactccccacccatcgcattgtctcatttatctggatgacaactggggagcctggagctggaaggacctggctggttgccctgggccagggggaggcatgtttcagatggagggtgggagctgacggtgggtgtgactcagcggcagggttaacccctgctccctggtcccgcagaccttccaggctcctaacttccagagatgagattctagctttacagagaatagcccatctggatacctgccaaaactctacagcattcctagaacaaggagagtcgcaaaactctagggtcagaaaaagaatgcccttgagtgccagagacactgcaagtcccaagtctcactgcaccctcgggtaggagcccccaggcagggtggggatggcgaagctgagacgagatgctcaggcccctgggactccggttgtctccactctggactccttcacctctttctttccgcttttgtcaactgaactggaggacaatagtccttctgcaccaaaaggtgactctttgttctataagtcacgggggttatatggtgacagctctctggtcaggctaatgccttaggaacaggtttaatgccctagggcctgtcagcacctggacccggtccagccatggacacccttattccaggaactctttgcagctgccaaaggcaggacaaagtcccacagggatgaggccgggagaggtgatgaggcgaggcacgagcagggggggggaataaggcccctccctgggctgaggtcagcgtttccctgaagttcaagtgcgtgcagtgatggactcattctgcctgcgcccaggggagacccttggcccttggggggacccccaggtggcccatggtacccaccagcccagcactacctccagtctccagcccaccctaggcctacttcttggccgtgtttcttctttagaatgactttagacgttccattcactggatagcaaatccaagcatttaatattagaaacaaggagagaaagaaagaacgagaacacgtgatgctgtagcccagaagagatggcacattcccctctcagtgatgatgccacaaacacggttacagggagggtgggaaagcctccccccacctcaaatccagaaggcacaaagataagcttgtcgttagtatgctgactctgctgcccactcatcagaatgtgcctgtttagcacaagtcactttagtctcctctctccactctgggagaggtgggggctgatggggggggggcctggccccgccagcagggaccatccccaccaaggctgggtcccggggcagcaggcccaaagcccgaggcccccagcagcttggggtcccctccccataatgtcccctggtcacacatgactctccagaccctggttaccctacaaagcagaggtcctgtcatctcacactcacccccgctgacttcctagggcttgagctcatggaaaagaaccaactagggcggggaaattaaagggtccattgggattccctttgcagcaaagggcagagagcagcagagaaatgaagatactcagattaaacagaatagcagacctgagacctgccagtcctgctaggcctgaaaatgagacaaaggattttaaatcggtattgcaagaacaccacgtgcacctggactgcagactggagtttccaggtcagcgctggtccctcgccaaacccacccccacggccccagtcacacccagcagtggggccagccccccctcctgtgcagctgagacctcgcccttgttggcctcccgtgcacgtgcgaccgcacaccagctgcctgcggatggccccttgcgggggcaggggctcggctgagccagggctcctcactttgacaaactccttgaagtctggggcctcgtcagtcttctgctggatcaaggcggccccgttgagctggcagctgcagaagcggatgtagggctgcatgtgtggcagctgggccgtcaggatgtctccgatcatcttcacgggcatcttctccccagacatcttcttgcggaccctcagcgctctgcacggaaacgcagcaagtgagcaccccaccttcgcgttctctgatgggaacatggcacacgtctaggtggcacagaaatgggatgtgtgtgaggggcacaaacccagggccactaagcatctatgtgggagacaagggacagaaaaagaaatgagtctagtgctacagagaggtgtccctggggcatttttctttttttggcatgatggttatctgctggctcttagaaagaaagactaaaaaaaaaaaaaattttttttttttttgccaaacaagtcagtataaaagacaatattttcgtgtggaaatatatagaatctttcttaaaaagaaaaataatctggacatgatccctgggtggatgtcttgcttgatgcatggtccatccaggctggtctggccccagccctgaatccatttccaggaccagtgctgtcacccaagggaagctgttgtggccaagggccgtggaggctcaatttcagatcaaacaaaacacaatgcagatggcaaatcaactgccacaggaaaagaatcccactatgttcatgaaagccaggtttaaatgatgggctgaactatctgtgcttcactgcttcactcctgtggccaacttgcagttgaccggattaagagagctctgaagagagaaggctatttatatgctaatggagcaatggacctggaagttgagaggggaccagaggggctgcaaagtgcttgttcaggagttctctgtagtctgagtgcttggggccgtgggagccaggacggtgcatctcaccctcctaacttgtatggcaactcctaaccaactacgataagaagggtacggtactgtgcttctacacaacagggacagcaatgtacccggaggcggggccacagcacgggaggccacgggcgagtcctgctcaccctagtgactatggatgatcaacacatggttggatagaacagaatggcgtaacacatgatttcatcgtaagcgtgggaggacgttactctgaactcctctggttgtcttcatggttgtgggtagggctatgtgattccccaaaggtgctgcggtcttagtatcaaagacttcagatcactttctttcccccacatctttggttaaagaaaaaaatttaaaaatctttgtactgggcaagcaagctaaggaaagaaactttagggacagtgccttatatggtctaaacaaccagttattccctccttaagcagatgccattgtgggaagaggtgctggccattgctggttggctggggcatgaggagtggcagcttggtatccccaggatggccaggtggcaactgcccattgggtggctggtgtggaatatctcccaacatgtagaaattggctaaagggcgacatcgccaccaattctggggggcgagagcggtgagtaaccaggttattaatacaaacttgggaagatggaaacaggaagaaattccatcattccatgattttccaatgaggagtaacatagtctttctgcaagggaataaaagtgtttttacctgcctccctcttttttctttttttctaaatgatgaggagacaagaaaaagggaaaaggaaaaagatgacacgcggatcattactgtgttgaggaagttaagccgggtcccaggttctgaggcccacacttgtagacttgagttgatcttgcatggggggcagacagggcctgcaatggaccaggcacctcttagggttagctgcgggcctccttctgggatgttctaccgaacaggactgggcttgagtgggtggaacaggggtcaccgggctcaggggccacatgaatgctgcagccacagcgccgccctttggggaactaatccgtaatctcacagaaagctcaatacatgcaaggtcttcaactgtgacagaaatcaaatcagtcagtgaacgcattggagtgctcgctgtttgctgagcaaaagagtaaccctctgaagtctgcggatcaagagaacgggcaagagagttggctttcatgaatgtgtcctaggcatcaaacactttttttttttttaacatgtatgacttattaggttggccaaaaatttcattcaggtttctccgtaagatggtatgaaaaatccgttatgaacctttcggccaccccaacagtatccctcttgactgttggggaaactgaggcacgtggcaatcgagtcacttgaccagagtcacacagcttagaggtgacaggaaaccctggaactcggggtgggggagggatctgactccagagcccatagagtataagcaccaagagcagccccacctccaagctgccctgggctcctggcccccctcgctccagatgtctcctgccattccgccaagaggggcttccccagcccctctgctctgccctccctgctggccttcctctcccctcctccaaggcactcccatctcccctctcaccctgtccatgcccagccaaagtccttccttctccccatcctgtctttacccaccaaggtatcttttttttggtgtataccttggagtatagtataccttgggcttccctggtgactcagatggtaaagcgtctgcctgctatcaatccttgggtcaggaagatcccctagaaggcaatggcaacccactccactattcttgcctggaaaatcccatggatggatgagcctggtagtctacagtccatggggttgtaaaccgttggacacagctgatcgacttctctctctttggagtatagttgctttacaatgtcatgttaatttctgctctacagtgacgtgaatcagctgtacatacatctcttcctgcttgagcctccctccccaccaccatcccacccctctggtcatcatgaagcatggagctgaactccctgagctatatagcaggttcccactagttatctattcaaggtatgttttctagttctaatccatttttctttgtttttctgccttaaagaaaactgtgtcttcttcttcttaaattattcttgttatcttcttctttggagaaggcaatggcaacccactccagtactcttgcctggaaaatcccatggacggaggagcctggtaggctgcagtccctggggtctcgaacagtcggacacgactgagtgacttcactttcacttttcacttttcactttcatgcattggagaaggaaatggcaacccactctagtgttcttgcctggagaatcccagagacggcggagcctggtgggctgccgtctgtggggtcgcacagagtcagacacgactgaagcaacgtagtagtagtagtagtatgttcttcttatcatacttaagttggaaactgaatacttaatatttaagaaaaactttttttggagaagctctttcatttatttttatttcttcaagcaaggaaacaggaaaagatctcgataaaaacagtttccagcacttggttccacacgccctatctcacttctacatcccttctcttatctcttctaatagccactcctaagggtctgcatctagctcctaactgtaaaaggttctagattcttctgtcctactctgctttcgaaggcaaatttctcagctctctgctcacaggtaagagagcccagaagcagcattagtaagaagtctgagcgccccaggtagctcccttttatgttcattatgtttgtttcttatttatctgtttaataaaccctatgtccccctttaagtacaagttgtcgctggcccttggatcaggagtggtgcataagtgactgtccactgcagccctccagggaatgaaagtgaaagtgttagttgctcagtcgtgtccaacccttttcgaccccatggactgtagcccaccaggctcctctgtccatggaattctccaggcaagaatactgcggtgggtatccattccctcctggtggctcaaatggtaaagaatctgccttcaatgcaggagacctgggttcaatccctgggtcgggaagatcccctgaagaaggaaatggcaacccactccagtattcttgcctggagaatccccatggacagaggattctggtgggctacagcccacgggggtcacaaagagtcggaacacgactgagcaacttcaccttcttcaggggatcttcccaacccagggatcgaaactgggtctaccacatagaaggtaggttctttaccatctgagccactgccttaaattctctttatcctcaaatgcctccctcttccattgtgccagaagccctaaatcttcccattgctgggattagtcctttgcacaaagaaggtaagtctaagcagtgaaattgtataatctacaatacgggtgctcatcatacaattctttccatttttcctggtatgtttgaaaatttttcataataagatgctgaaaggggaaaaaacaagaagagaaagaaagaaatcaggtctccagaaagctctttctaaatacaagtattaatattttatctggaagatgaaaagcttagccaaactaaccaatcaggtcatcagagatgatagaagatgggggtcagagatgcctgatggggccgtgattggcagggtaccagctgtacacctgatctacttgctccctggaataaccctgcatgctagactgggcaggtgctctgactgcaatcctacagcttctgaaacaaagggtcggggagttatctgcctgagataactgcccaaagtgagctagaaggtgctggagcccggatgaaaaattgagatgcctcccttctggtttcacctgctttctatcgagggcagaaccaggtggaacccctagtagggccctgagtgtcatccacagagcagcccggggccctgatccccttctgtgtgaccttggacaagtcactcaacctctctgagctcgtttccgcagcagcaagagtgctctcagttcctacctctggggctgtggagcgcatcggcgctgataggaggagggagcacacgggcctggccttgacagagcccaaaaaaggggcttccagttccctgtcaggagcaggagggagggttaaagtgcgaagacaacagaaaagcaagggggatgctgaggtggggtttaggggctctctggaacatcagacaggtctcccctctccccacccctcacacacccacccaaggaaagcagtgttagcgcgtaggtgtgttttcaacagaaggtctttgtgtgcgtttcaaaagaactcatctcccacccctttaggttgagtacttgtaggttcagggataaatgagcccacctgcccccaagtgacaaggcagcctctctccgaaggcaagagcgggtactcagctcaccccaaggcccaggcccagcacttactgtggaccaggcacttggtgtctaaatgctccttaatgagaaccctatgtggtggttactaccccactttacagatgaggacactgaggctcagggagcacaggtggcaatcagagcaggtgggcgacagcagggctgagagcccaagaatccgactcagatctatgctagaagactctgcagaatctttctcaagggagattaatggaaataccccctctaaaccatcctcatcccgtcatctttgattatttgtcttctagaacgtacagagagaggatgttctgcttttgcttcacgtccaccttgctgcaccgctctgtccatcccttcatccacgcccaaacacgctcacagtggagggctgaaatcactttagcaaatcccagggaccacacccaggaaagagctgcttcccgtttacacgaacctagagatcaggaggaaccaccagttcccagggcctgtgtgctgcctctgggatcccaggacaccatggacctaatctgtgttctagcaagtgttatacggaggcctggtggacacagatttggaggtttgttggtttttttttttagggattggatgatacaatccaaccccttccttttacaggtggggaaactgaggaagggcggtgagttgggctccaagcccaggtctgtagacacctggcccagtgtttctccctggccccgcagctgcgactgggaactgaaatatgaataaaatacccactgcttcaggccagtatctcagagggacatcctgagaaccactgtggaccgtggccatggacggtcccactgattcccatcttcaggaggcaagaaagtcccaagagaccaacgtgtccccctgtggatcctgggtctgagggaaggcacgagggctgccgctcaccctgggtggggccggtcagggatcagaacccaggatcagcccttctctgttcattctagaaccacggtaaaagtaggaactgggagacctgagaaatccaccctccccagggagaaactgggactgtgattctagaaggcatcaggcaagaaagagggatggtgcctgtgagcagaaatgaggaaaagatataggaagacacgcagggggggcatgcacggagaggacacacgcgtgaagccacgcgggggtgctagtgtgtgagcgcgaagccaggccgggggttagagaggagaggcttacttcagtagtttgatattacacataatcagctccttccagttaacaaaaatcatagcaccctctttttctgtcagcagctcagactccatcaggggtttctgaaagatctacagatgcagaaaacgaagcagttcagaaagcaaacagttagcttgaaattcaaacacacgcaacgcaccgatctgttcggagcaacgggaaggcctgaggcgtctgcagccctgctcggaggctcagaagccgcagagtttctgaagaaggtggtcctccctctgcctggggggagggggtgcacgggagcggggttccccattgggtccacgcacaggtttacaaggaggcccgctaaactctggaggaccggcctgaactcagctggggggtctgggcaaaggcactcacgctctcactagctggccacggctggacgtggggactgaaagatgccctggggtcggtggggggtggatcccgcattcctggcctggcatcagcggcccagacaagcctcaggagctcccggggagcagggcctccagccagcagcctcagggacgagatggaccccacagccctgcccacagtggggctggacctcaggcagagccagggggtgcaggcctagccccgagggggcgcagctcctctcctgggctccaggaaatacagatgcctgcccaagccccagaggggtgggccactcgcagtacatcacggatctcagctgagccccccagggagaggttgttgctacccctggaggcaggccactcactgcaaggttccttagggacctagtttattacagaccttagtttatttcagcctgtctttgaaataaacttggctgggctaaggctgatccccaggagcccctacccttcacgggtccttaagctgatgttgaaccgggcctccaccaggccacgcacaacgtaccacatttcagggcatgacactcacatcctcgacatgcaagactcctagtgacagtcctgtatcttgagaaaggggtgctttttcatcccaatgcttcctaagcactcacgatggccttgggggccatcaacccaccctgcgtctgggactgctcaacactggggcagtgagccttgtcttccctggtcagttatgaggagatgatcagaggagacggtttcatgactcgggggtgggggtgggggtggggttcccacactctcacagtacttcgcagactatagggggacccagacacccagctcggcaagcacctgacccctaacacgccaacgtcccacaggtctggaccaaaagcttcccaacaagcagggggttcccaactctgcatcttctcatccgcctggaccaggcagccaaggcctgtcaagagcttcctgggaggaaagccaaaatgaggcatcgtcctggacggggttggggggtgtgtgcacggggccccagggaggaaacatcttcattccctttaacggacgtttctcgggagtcatgggcggcatgaggaataatgcaagccatcagccccgctggccgccgttttgaaacactactgccaagggccgggaggtggtgctctgtggtgtcgggtagttggtggcaagttctctgagtggagccctgatgcccacctcgccgctgtgagtcccgccccaggtctcctcgccccgacgcccacctcgctgctgtgtgtcctactccaggcctcctcacgggcttgtctgtccctggcttgagggacctctgccctctctgtggacaggactcccagttggccatggatgagaaggaaccctcttctctcgggacagcgtctcttacgtgacatcccgtccagaggctcccacacacctgagagcttctcagcctgggaagcaggaccccacctccttgacagggaccccagcccccgcccggcacccccagccgccctcacctctgtgaccagctgcaggtcattcacgtagttctcctccgtgacgatgagctcgtggatgtacccctgtcgctttctttcagttggggtcagcatatccaagaggtgtaagtctgagcaccctgcaaaacacaaccatggggaccgtttagcccaggcctggggagcttcatggggaaggttccccagggccctgcggtctcgaatcagtgggaccgttgtcgtcccctaaacagatgggtccaagtcctaccccagcactttgtgaaagtgagcttatttggaaatagggcctccagatgcaatcaaattaagatggagtcacactcgggactccacagggcagcccagtggttaagactctgtacttccattgcagggggcccaggttcagtccctggcttgggaactaagatcagtgcatgcaatgtgacgtgaccaaaaaataattaacattaaaaaaaaaaaagatgaagtcatattcagttggggcaggacctaagtcaatatgactgttgttcttatggacacagagacagacaaggaacaccacgtgacaacagaggcagagactagagtgacgtgtctacaagccgaggaatgccagggattgctgtcagcatcagaagctcatggaaaggcatgaaacgaactctcctctgaagctgtcaaaggaacatggccctgcccaagccttgattttggacgtctcacctctagaactagcagaaaattaatttctgttgttttaagcccgcccagtttgtgggcatctctttttgccttttcatactgttcatgaggttggaaaagaccctgatgctgggaaagattgagggcaggaggggaagggggcgacagaggatgagatggttggatggcatcacggactgcatggacatgagtttgagcgaactccgggagacaagaagaccagggaagcccagcgtgctgcagtccatggggtcgcaaagagtcagacacaactgagcgagtgaacagtaagtttgtggtcatctgttacagcagccacaggagactaacacagacggtacacgcctgcttcagcagaaccgctgagagtgctgagagtgagaagccatagtgacagctggctgacattccccgagggctcacaccgtgccaggtgctgtcccaggagctagatcctgacagctgtgtttaatgctcacttagatcctacaaatatctccattttacagacagggaaactgaggcttcgaaaggttgcctcacccaaactctgtcagcagggtgatgatggtgaagccaagacaggaccctgacaccgtgatcagagcctgggctcctacctcagatcactgctgctgggtcccaggtacattagtggggcagatggttgtctcaagtttggtttttggaggatgaggcagctatgctgagactctgaagaggcctggggacagggccaatgtgggcacatccagacaccactgggcaaactctcctggaccaggctgcggccctgcacccacgggaccttggtggctggacgcaactgtggctgcagctccccaggggagtaggttctgtggccctgtgccgggtgggagtgggcatgcacagcaggtgatgcctgccctggcttctactcacttagctggttattggggtttgtccggttctaatgttctcaggttataatcctaggctgccccctgacttgggcacactggaatgctgggtggggaaactcgattctcaggggtaccccccatgcaggtctggacccacttcttccaggtcagggttcccctacccccttctttttatcaagggtttcttttttcagtcacagaaaccagatttgtaaagaagactgggaggtgtcttggatgtaggtgggggtgaaggcacagagtcccatttcactctgttctcatccctccttctcccacaagggggcaccatggagcacagtgtgaaaccctgccaccagacaccagccgttctcgaagtggggtccccaggccagcagcatcagtagcacctaggtgctaactagaaatgcagattctcaggcttctgctgaattgactgtgggatcagggcccaggagtctgatttaacaagctctctgggtgactttttagggacactaaagtttgagagggcttccctggcagctcagactgtgaagactctgcctgcgatgtgggagacccaggttcgatccccaggttgggaaaatcccctggagaaggtaacagcaacccacttccatattcttgccaggagaatcccatggacagaggaggctggtgagctacagtccatggggccgcaaagagtcaggcacaactgagtaactaacacacacatggtttgagaagcctgctctgaaatctggttcctcagcttccatctttccctgagggagtttctccgttcatgactgatctagtccagatgctggaagcttctgcaaaaagaatgattcttctggggtgaatggtaaacgcttcattgtgcccgagattgactccaagttcagagtcaatctcgggcacttccaactttcagttttgtcccctcccctggccaacttccctttctagaattctagagcatctcttcctaggctaggacaatcccaggatggacagactgatgctgggaaagcctcagggatgagccatcatcatattaacacctggcacacccttccatccaagacctcattcaaagccactgcagtggggccagaccacagttccacagggccacgggccgagaacgaacctttgcttaggtctgcagatgcttctggaccttgagccctctgctcagccaccagctcagcccagctgtccttcctgccccagcacaaagtgttttacttaaacaattgcatcgacagcgaatcctcaggaaggaagcaagtcatgattgctcccttgctggcctcagccgccctctgctgagctgctgcacgagccccagcttacaggacgctgagtgatatcaccgatttctttgtctttcatgaagagagccacccaaaaaacactcctgagattggcaggaaaatatctcccttctgtcctgttctcacccaactctcctgtcagggaatccaagtgcccagcttcaaggtcgtttcttgttaaagggtagaataccgcccttgcacttcagagacatgtatgaacatggcggagcagtctcccctgcaattctcagcacatttctttctgcaagggtatcaggataatggtagagaccagtagctctaaagctcagctcacacccactatgcaatgccatttgtagggatacaaacatcagcctagtagtggacactggttagaccagtcaccccaacatctgtgtagatcacaatttcccctggagaatctggtggatgctagaatccttacccctccaagaaaacttatggatacaatgcacatgatatacagacccattctgcacacagttttacaggattcatagaccttcttgaagcttgttcatggatttcattccttcattcatttgacaaatatttactgatatcttaacacaagtctggcactaactgccaggtgctgggaattcaagatggaagaggagaaatgcctgaccctcagaacatacagctatgaactcagggtcttcagctaggggtagtgccctccgcaggctgaagagggtactctcccccacaggctgaagatggtactgcccccaacaggttgaaggtggtactgccccccacaggctgaagatggttcagttcagttcagttgctcagtcatgtccgactatttgcaaccccatcaatcacagcacaacaggcctccctgtccatcaccaatgcccagagttcactcaaactcatgtccatccagtcagtgatgccatccagccatctcatcctctgtcgccctcttctcctcctgccctcaatccctcccagcatcagggtcttttccaatgagtcagctcttcacatgaggtggccaaagtactggagtttcagctttacatcagtccttccaatgaacacccaggactaatatcctttaggatggagtggttggatctccttgcagtccaagggactctcaaaagtcttctccagcaccacagttcaaaagcatcaattcttcggtgctcagctttcttcacagtccaactctcacatccatacataaccactggaaaaaccatagccttgactagatggacctttgttggcaaggtactgtctctgcttttcaatatgctgtctaggttggtcataactttccttccaaggagtaagcgtcttttaatttcatggctgcaatcaccatctgcagtgattttggagccccccaaaataaagtctgacactgtttccccatctatttgccatgaagtgatgggaccagatgccatgatcttagttttctgaatgttgagctttaagccaactttttcactctcctctttcactttcatcaagaaacttttagttcctcttcactttctgccataagggtggtgtcatatgcatatctgaggttattgatatttctccctgaaatcttgattccagcttgtgcttcttccagctgcactttgctggagcagcagtgaagagataccccacatccaaggtaagagaaacccaagtaagactgtagtgtaggtgttgcgagagggcatcagagggtagacacactgaaaccataatcacagaaaactagccaatctgatcacacggaccgcagccttgtctaactcaatgaaagtaagccatgccacgtggggccacccaagacgggagagtcatggtggagaggtctgtcagaatgtggtccactggagaagggaatggcaaaccacttcagtattcttgccttgagaaccccatgaacagtaagaaaaggcaaaatgataggatactgaaaggggaactccctggatcagtaggtgcccaatatgctactggagatcagtggagaaataactccagaaagaatgaagggatggagccaaagcaaaaacaatacccagttgtggatgtgattggtgatagaagcaaggtccgatgctgtaaagagcaatattgcataggaatctggctgaagatggtactgcccccataggctaaagatggtactgccccccacaggctgaagatggtactgcaccaccaggttgaaggtggtactgccccacctgccccccacaggttgaagatggtactgccccctacaggctgaaggtagtattgctccccaccaggttcagggttgcactgcacccacaccccaaactccaaattcttggttgtcataatgactggactgagccagggcagatgactggtaatatatgggacagagaagggctcacctcaaatgtcaatgctgctgctgctgtgtcgcttcagtcgtgtccgactctgtgcgaccccatagacagcagcccaccaggcctcccgtccctgtgattctccaggcaagaacactggagtgggttgccatttccttctccaatgcatgaaagtgaaaagtgaaagtgaagtcgctcagtcatgtccgactctagtgaccccatggactgcagcctaccaggctcctccgtccatgggattttctaggcaaaagtactggagtggggtgtcaatagcaccccactaagaaatgatgacattcctagaaactgacaactctgcagcaagaatggggcatgtgacctgagatacacagaatgactgacgaaacagacataagaaccagtgaggaaagatgacaggaactggcttgctttggatttcggcaattcattcttcagaatcttcaagtgttacacagtgtggttgggaagaagctcagagccaggaaacaacaggaagtccagggtggatttgggccattggtctaagaatcccagctgctggggccagttcagggtgaactgaccatctcctactcatggggtcagagggcatgaaaaggctgtatggcctcctactccagtcagctccagccttcagtcaatctacccaacaggcagagaagttttggaggtcagtgctgtgtgagtctggtttattggccccaacaaatcccacccttcactgccccccctactagcctgcctggagagagaaggatggtccagatgacctctccaggacccagaacacaatgaaaagtaaagatttgggggtggggtgaagattcatctcagcattatgtgccaacaatgctggcttggaacagtcttttcagctactgaaccaacccataggatactgttttaaaaattcttgctggtgaatgccagaccaagaaaaccatttaagacttgaaacaggcgctttgaactaaaaaatatccttcctttgaaattttaatacttagaaaaacaagagagcttaaaaagcaaaccattattcagagtagggtaagtggaaaggacatttcaaatgagagggttttctttaggggtggagggacgtggtccttctctcttttgggaaccagaataaacattctgtgctgacttcctttcccagtgaaaaatgagagggtaaaacacagcaaataaattccacggacatctcagtgtgatggagggactcttataactaactagaatccactcacagctgaaataatattgcaatgacttcaggcagttagaaatgatccccaattacaacccacataaaattcctaatctatgtgctatcccttatagcttcatgcagttacacacatttgcagaacagagagaaccacaatgctcctccctgccccccagaaaggattcaagtatggaatactagagaaaagtaccttatccccaaagataatcttgtccctttaatgggacattgttcacagggacagcataatctaaataaattgctttattacaaaagtaatgcatgaacatacgcttattgtaaacagttcaaatgacatagaagggtaaaaagcgagagttgctctctccagagctccaactatcctacttccttttccaacagggaccagaattcttaaaaccaaaccaggccccacagcaagctggccacagagcaaagcaaataaacaggcctcattcctgttatgaatgggccaaaatatactatgagatggtcaataaatatgcattaaattccccttgaagtccaagagacacagaaagcaaggcaatgtccttgtcctcaaggaaactcacagttctgggggaaacttgatgtgaaaattaaatataaaatagcaagcagtaaagaatggcctgtgggctgtgccgatggtggaggctgcaggaactcagaaaagtagatgttctctgtcctgttggaggaaggttctacgaggacctgatcatatgtgtgccaggtttccatatagctggggaggaggggggcattatgctggggcatggggccagagtgccaggtacatgccgggatgctgcaaaagataagccaggggcgcgggcagggtaggaagtagatgaagtgagaagtggattaaagaggtcataatgccagagggatcgagaaaagagcaatatggaagcttgggccctgatttttcatctttaagggaaaggatctactgatatctctgaggaccttcagcccaaatcctctggctaaatggccccaggaaatttcccgggtggtccagtggttaagacttttttcttccaatgcagggtatgtgggtttgatgcctggtcagggaactaagatcccacatgccacacgataaagccaaaaacttttaaaaataataataataaataaaatgctatttgtgacccaatggactgtagcctgccaggctcctctgtccatggaattctgcaggcaagaatgctggagtgggtagctcttcccttctccaggggatcttcccaatccagggctcgaacccaggtctcccacattgcagggggattctttaccgtttgagctaccagggaagcccacccctccctacttaaaaaaattaattaaaaaaataaatggccccaggttcgggggccagttaacccagtttctggagctggcatctacacagaaggcatctccagggttggcctgagcagaggaagtggaaaagccacagccctggtgtctcctgccaggtgtgagcttaattccctccaggctacctagatcctcctgggaaaatgaatctaatctaatgtcctccacctccagggcacagtggcatgtgtgaggcagcccatcatgtagggaaggcagatgaagcccacaatggatgggtcgaaaagaagactctgtgatcaaagccgtttttccttgccctgcagctgatgtctgagcccctcctctctgacctgtgctcttatgtgtatgtgttcagtcactaagccacattcaacaatttgtgatcccacggactgcagcatgccaggcttccctgtctttcactatctctcagagtttgctcaaattcatgtccattgagtgagtgatgccatccacccatctcatcctctgtcgttcccttcttctttttccttcagtctttcctagcatcaaggtcttttccaatgagtcagctcttggaatcaggtagccaaagtactggagcttcagtgtcagtccttccaatgaatattcaggactgatttcctttagaatggactgctttgatctctttgcagtccaagggactttcaagagtcttctccagcaccacagttcaaaagcatcaattcttcggcactcagccttctttacggtccaactatcacatttccgtatatgactactggaaaaaccatagctttgactgtatttatgcattttcacggtatgaccgtaactgtgcttgatgctgggattcagtgatgaaggaagtaagacaggtgtttgtcctgcgggagccttggtccactagcagctgaaccatctcatccacactctgatctttgccgatgtgcagtcatctcgtagaaggcaccatgccccttgtcatccacgcctgagacctcagagttgcaaatccctaagattggatttttatgtgggggtctagagatgccaggtggacatggaggcctgtagcgagagttggggaaaattccacccaatgacaccaaagccctcactgggatatgtctagctgagatcaggcacccttctccagcctgtcctgggtatcccccacggccttcgactcagctgcactcagtcccaatccagaatcttaaaagttgcaacgtggtttccagattagcttaattctctcccaagaaggagaatccagctccatggactgctaggcagtttcatgactgttgagaagcagtgaaaatccaattactctcagggataagtcatctctttattttgcatcaagaactttagtaattttttttctaatcaaaggcatatcagtcatgactttataactaacgctggaattcctggcacgctgtcaagcgccccactggtctgcacttgttagctcattcctggcctctttaatgtcacccaccatccttatttccctttctttctgagttcctgctttcaatgtgcgccatcatgcagtattttaggggtccttggtgttgtcattatttagttgttaagccgagtcttacccttttgtgaccccatggatgatagccagccaggctcctctgtccctgggattttccaggcaagaatactggagtaggttgcaatttcttcctccagggatcttcctgaccctgggatcgaacccacgtctcctgcctctcctgcactgacaggtggattcttcccactgagcctcctgggaagcccttaggtgtccttactagccaccttaaataaatcctttgggtacacaaggcagattaaggtattggaagtacaaacacacttttattgcagtatgatgaaggaggctgtggttttgcttagagggatccaggaatatttttcagaggaggaggaattcaagttgggcttcattgggcaaaagggtgggtgggtaggagtgagtaaacatagagagggagccatcagtgaaaacaggggtaagagtggggtggtggggccaggaagcaggtgaggaagagggaagcagaggctggggtaccaagagggaaggaaagttagcatggatgctactctgagccacacggttccaagcacagttcatggactcacggaatcctccccaataatcctatgtgctagctatggctgctatacccccttgaacagatagggaaatggaggcacagagatgttaaggaacttggcagagcctctgttaataaaaggtagagggaatccgacccccgtgttcacggtcctgatcactctgcctctcgccttggtggaagggtgatgagtcagtcggccagactgctggaacaaagacggggcggcttagaccacagccatgtgttgtcccacaagtctggaggctggaagtccaagattaagatgtgatcgagtcttggccggccgtcttctccctgtgtcctcacatggactttcctctgtgtgccctcatccctggcgactcttggtgcccagaagtcttcttattaaggacaccagtcagattggatgagggcccatgctgatggccgcatcttaatgaccctttaaaggccccatctccaaacacagtcatattctgaggcatgaagaataagggtacgcgcttcaacacgtgcattttggagccacgtttcagcccctagtaagcggggaagcgcggtccagggggctctggatgaaagagtgaggcacctgcactttgtcggcgggggttgctgtgcgggttttctgggcaggctctctctagctgcggggagctttctcttcattgtgatgcacacacctctcgttgcggtggcttctcgtttcagagcacaggctccagtgtacgaagactcagtagttgtggcacatgggctcagtttctccatggcgtgtggaatcgtcctagataatcaaacccatgtctcctgcatgggcaggtcgattcttaaccactggaccaccagggaagcccagtgtctgcatttttgtctttggctggggagctcaggaaggtctggctgtactttgggagggtcactgcagcagctacaagaaggatggaggcgggtcatggctcttgagtttggctgcacatcagaatcactgaagaagtgaaagtgaaaatcgctcagttgtgtccgagtttttttgaccccatgcactgtagcctgccaggctcctctgtccatggaattctccaggcaaggatacaggagtgggttgtcatttccttctccagaggatcttcccaacccagggatcaaacccaggtctagtgcatggcaggtggattgtttaccatctgagccaccagggaagcccaagaatactgaagtgggtagcctatcccttctccaggggatcttcccaacccagggatcaaacccaggtctcctgcattgcaggtggattctttaccagctgagctaccagggaagctcagaaccacctaatgagactttaaaaaagcccagtgtccctgctgtaccccatatccaccaaatcttactggatggggtgcgacctaggtgtccataacttgtgaagctttcaagtggttctgatgtccagccaagagtgaggaccacgccatgatgggaagcttgcctggaaacaaggtgcctggtgtggaaagggagcgagattcagaaactagatctgtccaggcacatgccagatgagggtggccacaaccactgaaccgaatgcagcccaaggcaggtcactcagggcacttgtccaaggagacgtgatggccgtgaccacagaatgccatcctctgaggccatccacatgccagagtccagagaacctccgatgcttcgttcccggagaccacactgccatcaccagactccagcaccagggccagagcttgaaaggtcactctgcttgatgccctcattttatggatgggacagtagagtccagagatggatgaagatcaggaataaaacttctgccatcaggaataactttttgctcttgctgtcttgggaaatgcagactcaccaggaaatcgtgagcttgtaaaagagcaggtctgagagtagtccatacctgtggctctcccagtccattcccagatagcccagttgagaggagactcccgtcctcggagctggagactgctgggggccggtggcaaccaggctgggtcaaggcagctggtcccaggttgaccagtcccagggaaactccagcccagaggcagctctggacaccagaccagatcagggtggtccatggacaggtggggacttctcatcgcgacggaactttcttcccaagggtctaagaacagcctggtcccctgcggtcctcctaacttggccaactgaccccgccagaacacaagagaccacctgagcccgtgacatctcttgctcatttgtcagcaacggcagagaggcacccaggtccctgctttcatggagcttccattctagcggaggggagacagaaaaccaaacacagaatcaatacatagtattcaggatggtataagactgatgagtaataagtctcacgagtaagaagctcattgcctggtctagggtcttctgtggatttatcctttcaacagtggtgcttccccagacacagctggtgtgctgttctaagccacatgcagcggggagactggacactagggagggggctttcctttctctccagcctttctgggcaggaaggagtgagcctgtggaacaacagggtggaaacaggactgttcattctggacacttcctaagcaaggcactctgggtgatacccaggtggagaggtaggttccacctccagtttctaagctgacagggaggacttggtgtcaggcaatactaaatacaaaggcagctcccactgctattgattcacgtttgtaggtcttcatgggatagggcctggctcccgagaagctcacagtctaaggagggagtgtctgtgcgtcagtctccatccactcagtttaggtacaacaagtgactgggattcagcaaagtgctcagacatggcgggtgagtggagctggccaaggcagcagagaaagaaggggtggaggcaggcaaacagctggggaagatggggtgaaggcattcaagccgaggcccaccagtggcttcagcttcatgcaagaatcttggagaccgtggggatagaaggtctgggtaggtgagactcaataggcaaaaggaagggctggatgatgggaatccgtcgactgaagcctgagcaccacctcccactggatgtgcaggcacacagagccctggaaggaagacgaacctcagggaggttgacttgcgccatctccaaggcagagaaagcctccacatccatgccatctcccagccacgatgccacagtggggaccggtgatgaaagcagacctctccatcacgtaatctggaagtcagatgagacggttttccagagagcgagctggaaacccactggggcatcagaagcctggacttctgtttagggttagcgtggtgatcccaaaggtggccgaaagagctagaaagaacattagaccatgaggcggcagatcagcctgggacttcacctctttaagcaccagcatctcctcccggaagccagagtggccacagcccctgcccctaaaacccgttttgatgtcagaaacctggaaggtttttaggttaacagcagtcacctaataatggtcctgtcagcagattagaaaggaaggccctggttggagaaggccgagcacaaatgggcaaataggtgggactaggagatccaagcagtccatcctgaaggagatcagtcctgggtgttcattggaaggactgatgttgaagctgaaaccccaatactgtggccgcctaatgcaaagagctgactcatttgaaaagaccctgatgctgggaaagattgagggcgggaggagaaggggacgacagaggatgagatggttggatggcatcaccgactcaatggacatgagtttgggtggactccaggagttggtgatggacagggaggcctggcgtgctgcagtccatggggtcacaaagagccggactcgactgagcgactgaactgaactgaactgaaacgaggagagagttgggccaggtgagggcctcacatgggtgggagaaggaagtaggatcaagcagggcctcacagatcaaatgcaagatttaggacgtcatcccaggagcactaggacacccctggacaattttaagcaaaaatagttgcatgcctatgtgtgtcctaacatttacttatttatttggctgcctctggtcctcgttgcgtcatgcaggagttttcactgctggatctggactctctagtcgcagcgcctcggctccggagtgcactagctcagtcgttgcaacatgtgggcttagttgctccgaagcatgtgagatctcagttcctcaagggattgaacacacatcccctacattgtgaggtggatacttaactactggaccgttggggtgactccagttgttaggttctcaaaataactctctgcctgtggtatgcagaagaggctggaagatgggaagcaggaagcaggtaccaagtagaagacttgtgtgtctttatgaaaggagcaggagaaatccatcagccctcagggcctttgcacctgccattcctggggcttagattgcgctcgcccttaaggcttgcatgccggccctccatgccctctgatcttccgccacctgtcgcttcttcagagaagccacgtgctccaaccctggccctccggcacacgcagcccatttcagccaccaccgactgcaatgattctgaaacgagtctgctcctcctcccgctcctgcaagcttcaggagcacaggtgcctcgtctgctggggttctgctgagcccagtctcatcacctggatctgtattcctcagccaatattccccaggaaggagcagcaggagaggagctgtctgctagagatcgcaggcaggcttgtctcaagggtggcgtcctgagcctttgatacagcagtcaggaggtgggtggggagggaggggacagacagatgtccttctgccccttgacgatggggcgcgggtagggggaaggttactgccagagatcacaccagcggaggattcagactttggggttcttctcatgggggcctcaggactccaaggtaacgccccagagaggaggcagagaaggtcttctggctgcgcctctgctgctgaggccggagggtcagtgagcagggcagaggttcccaggcccaaagatccggatcctgagaaacacagggaggcaggagggaattaacttcctgtcttcaagtgtgctgggggcggctgctcaggagacggtaccgtggggaagcaccccctagggacacacgttccttagccaagccgcatggttgctttaaaaaaaacatcgagcttctggcatgtttgggggccaaacgttccagtctctgctggcaagagaacacaaggccgcagaacgcagggatgagaaataaaggacccagtgactcaatgcctgtgtgacaggtttattgtggtgcgccgcctgggcttgccaaccaaacccacagatgtgacatttgaaagccgcatgcattccacgggctctgttggcctccccgctaccaaccagccgtgtgaaatccggggcagcttctccccctctgctaggagggctgctgaggctggggcccagggcctgggtgtccctgcacgtttagagaacatgggaaggtgtcgagaaaaaaaaaaaaagctgctggcttcgacatgggtgggcctcccactgacacagagggggcccccgctctgcacacacgtgaatgaggcagtctgacagttttcggggaagctgtccaagctctctgaaatccccatctgcaaaagcatgttttccaaaaagtcttaaaatgcacacaatctataggctgcctgagttgaatgcaagaaagcaggaagtcagttaaatgcattccgtgattctcaccaaccaggcacaaatgcctcttctcccagcaacggtaacaacaaggctaatatctatcgggagcttaatatctgctaggtgctactgtgatctttccatctggacacgaggaaactgaagcacaaagaggactaagtaatctgaccgtgaccacacaacccgtaagaggcagagctgggattcaaacacgcgctgtcctgccatcttgtcctgcttcctagcctctaaaagggcccaggatacagttatgtggctccctcatgctcccctctactactccccagaggaaaataaaacattccagggaatcccctgatggtgcgtggttagggtggctcaatggtagagaacccacctgccaatgagtcaggaagattccctcgagaaggaaatggcaacccacgccagtattctagcctgggaaatcccatggacagaggagcctcgtgggctatagtccatggggtcgcaaaagagtcggacatgacttagtgactaaacaattacaaccagtggttaggactcagtgctttcattgctgtagactgtttcaatccctgtttggggaactaagatcccctaagccgcacagcgcagccaagagaaaagaaaaggaaagaaaagcaagttttccaaaattttaaaagaaatggagccaaatattacattaatattgtagataagttgtgttattatatacggcagccaaggaatgaaaattgagaagctaggctgggcacagagcaaggagggcaaggctgtctttggaaaatccgcctgcggttggggtgagaaggactaaaggctgaagaagccagtggcatctcgagcctgtgtgttgaaggggttcgaatccttccctcccacggagccccagccaggggaggaccacgcaaggggaaggggaactggttctccgtctttccacagatgcagcccctgatgaagagaaggcaggcggctctgaggccctggcagagatgggctgctttctcaaaatcaccccgtgagagaggagcagaaggcaaatcctggagctgcctttgagaatgtcactacagctcccggaccctcagcgccctcagctacaaactgcaggctggatgcccagtgctctccaagattccagcctcaccaactaatctacctgccaccaccctggccctttcctgtgaggggagccgggactgcaacagagtggactggtgtgcatgaaagcatggggcagggcccgaggggggaaaggacagcttgggccttgtaagcggagtcacgttacgcgatactgagtggcatagcatcctccatgaacaatggcagctcctcctcctgggtctgttaggagaagctacatctagaagatgctctcatttttaaaagcactgagagggtaacaggcaggaaggccagaggttcccaagtggcaggcggtaataaactgcacgtggcagatgttttttttttttttttttttcccttctctacacaagatgaaaagaggcttcttttaattctgtgttaaggacatctggttctgccttgagctaaccaatgtacttttcttatggaaatgtttttcttaatgaaactatgtatttgctttgcaatttgcctttcttcaaaatggttctgcctaagactaacctttttttcttttctcaaaccttgggctgctaatggctcaacaaaccagtattcctgtcaattgttttatggccagggtggggaatgacacgtctcgtgccatcctatctcaaaattgcctattgtggaggggcctggtgaaactccctcagccttgaggtgtctctcttatctgattaatagctttctaacagacataaaacaccttgctaaaaactagcaagggggcactctttctgtccccttctgacgtctatgtcagaagctttccctatctctattacactttaacaaaactttgctacacaaaaagctccaagtagtcaagccttgtctctgaccctggatcaaaatcctctcctccagaagtcatgaatcctagctcaacacagggctcgcagcagcaacctttcaacatgatgggctgggtcaaaaggaagggacacttcctcttttgaggctctgacactatgtgccaagcagatgtgggaacagcagctgtcagcctctaccagaatctttgatagagttatacttgtctgcttgctggtggcactgtgaccaagctactgatgtgggcgtttaaatcacagtctctctgggtctgtcacacacacacacacacacatccagcctgttgacaacataaaataacattgctgctgctgctgctaaggcgcttcagtcgtgtccaactctgtgcgaccccatagacggcagcccaccaggctccccggtccctgggattctccaggcaagaacactggagtgggttgccatttccttctccaatgcatgaaagtgaaaagtgaaagtgaagccgctcagttgtgtccgactcttagagaccccatggactgcagcctaccaggctcctccgtccataggattgtccaggcaagagtactggagtggggtgcgattgccttctccaaaataacactgtagcatgcttaacaggaagttgtattgacacaacaattttatggctgattctcatcttctataaacaacacaaatttttgtgactgaagttatattatctttaaaaaaatgcctgagttttcaattcaaagaacagaaccttcttaagaggcaacggaaacttctgaaatggaattgccacacacccaggaaaatattctggaagtccgctttttatgtgtggcgttttcttaaagaaagccccaacagaggcctggctgcaatgagatattcacatggagctgttgtgatccttgactttattatgtttctctagcctaccagatccaaaacatcaaacatttctaagaaagggctatttttctggacagttctggaaccgctggcattccatgcagtttccataaaaaattctcttgggtattttgggaatgaaaaagaatgaataggattaacttatcactttgctagaagggaaaatgaatattcactgtccttcagaagtgatgttcactcctccaggaagcaggactgactgagtgtcaggcccattccccagctgagactggggctggcacggagaccaggcaatgccccagcatccctggtcctcagcctccttcactgaccactgatggagcggcttcaggaacagcacctgccaaggagacttgctctggggaagctcacgcctaaaagggaaggcagacacagcatggtctcctctccagcggggatggattgtatgagaacctgaactcagtgctttcctgtttcactaatccctggacccacccattcaacaggctttcttgagcacctgccctacagcatgcctggttgtatgagtgtactaggttgagtcacatgcaatcgctgttttataggtaagaagaatactggcaaatgtttcatatgggtaaaccgcttcgatgggcttcctaaacaagggttagcaggtttttcttctggtggcacctgagaaggtggttgtggttgttgttcagtcattaagtcatgtccggctctgtgaccccatggactaaagcatgccaggcttccctgtctttcatgatctcctggagtttgctcagactcatgtccattgagttgatgaggctgtctcatcctctcaaacagaaaagaactcaccaagcatttgtctgttcacccgctaacagggaatgtgagctgggtctagaccgctgtaagagaggttagttttaccctaccgatgatgtgctgttgccatagtaatcctgctcagtttgagaggaaccgcagaggaccagttaccacttggtaggggatctgggcctgcccttttttctcccagaacagagtggacatgcaatgacatacagctctgtaaccttacaagggaatgaatccttcctttagactggcttctcccagacatcgttttaagcagaggcagcctggagcgtgggccacgtggccaccttcagccctgtgggttctgctctgcacagcagaggcagccagacacagaaaagcaagtcagaacggcaaaacgaaggccctctcatgtgtccatgtgcctctggggcaaaactgtacctagagttcagtcgtaaaaatattcacccagagcaaccaggggaatattgcccacagcagccagagggatgagagaccaggctgtctcagccctggtactggtgacacgggaccacgtccgctgtgggggtcatcctgtgcattgcaggatcttcagcagcaaccccgcctctacccaccagaggctgtcatcttccttccctctggttgagaagcccagggtcagaaggacactatgatcaaatgcaaactgcatgatctgtgagggggaaagagcaagattcctggagacaaacctgtgtcaacacagcctaagagggttgatctacagagagggggatggagagagagagttgtggagagtattatcgtggattacccaccttgacaattgcatctctgctagccaaaactcaaagctggaaacactgacttattcgggtgaagggggcggggtggggggtgggagcaggtggtcctggacaagagacagggctttgctgaccaagagggtagggtggggggcagtgatggggatctctccctgcaccttggggcccctgtatgacacttctgcctcaaacagccccttctcttcccagcttcatctggctccttctcatccttaggtctcccttctttctggaagggttccctgatctctccctgcagctgcccttcccgaacgttggctttggatgtcctcctcagggtcacctggcacccgttagctgtcctggcacagaatgcatcagcttctctcacacacgcacacacacccctcatatatttatgtacatacatgtatgcagcagtttggttttctgcttgttcctcccattagaaagtgaactccatgaggacagggacccagtcttcactgatggagtggcactctctgccccagaacccagagcagcgtccacacctggtaagtctctccccgcaactatttgctgaactgatgaaggaactcacttttccactgaatggcaggggaggaccaataagcgaggttcctgaacggattcaagccgtggtctgtcgtagccaacagtttcatcagggtgtatacccgtctgtttctgcaaattcaactggagtttgcaaggcagatacagatggcaaacaatggcatggaagatgtgaaagtttcaggatttacttacatctgtcagctcaacagacccttttgtgatcaccttttgggcaaatgtgtggttctctgagtcacatcgctcacctgtcaatgtatcaatagcacatatgaaagcccgatgagagagttaagctcaaagctgaattgccgtcttttttttcctatttttggctgcaccatgcagcatgcaggaccttagttccctgaccagggatcgaacccctgccccttgcagtggcagtgtgatgtcttaaccactggaccaccaggaaagtcccgggagttctattcttcaaaatcagtattaggaagggtacctgtctgcatgttgatcagggaggggcaggtagcagggtaagagcgagggtccccatggcatctgtatcataatggacacgtgggcagcaggccacctgcttaggtctagtctggctggttccccatcaccactgccaccttccaacatcaagaacacagagacatttccgtctaacttttatatgaagaatttaattatctatacacataactaattcaaaaggttgtattacagttgttaaagccgcaggtttatatatttatatattttacattcatatccatgaaaatactgacgcgccagcgaacgaggcggtgtcctcgttctcggcaccgtgtgagtggagaaggaccgctacacaatgccagcacagagtccccaaggggacagacgtaaaacagaagatcactactgttaaaaagtcattagtagaaccgctaggttgtgcttgaggctccctgccccccgccccgttttctgtgctgtcagcaacggcgtttttattgagagcttccaactagtgtttaaaagacacacatggcttcagctacaacatccaacacatcaacggaccatgagctccatttcatattaacctgtagaaattccacagtctagttaaaaaatgtaaacattggaaattaattgcagggagactcctatacattctttcttgtcaagaaaattacttgtttgaaatcgtcattccatgaagtcactggaataaaacttggtgtaacagagactaaggcgagattgtagatactgttgaccgtgacaacctcaaaggtatcgtctacggatttatggtatgaaaatatgcaaaattaaaaaccccaaacagaaaacaccaactcaaccagataaatctgagaccgaacaaaaacacacatgctttctcatggggctacaaggtcactgtgcaaaataaaattaatgcaatgtgattagagcatcatacaaggtaatagcttttgccatggaaagaactaatttcatatgtacaggatgtattattacatgctcagcaaggtacatctgatacacacaaacaagcacaaaacaccttctgtttaattggcctcattctacacgtctttaaaacagatatactgaactcctctgtacttctacagtagggggcaacaaacccaaactacacaatttagttgataacactggacagaatgaaaaacaaaaaatacatcaagtctcagatttatggacatttggaaacatttttttaatagcacatgcagcattccttgatagtgggtctttttgcaaaaccaaaatagcaaagaagtcattcatttttttttttttattaaaaggctaaaagatttattgaaaaataatttgaaaactattgaaagcacctgtgcaaaggtggggggaagtcaatttgagtcactaggaaagccacaaaaggacccactaccctgtgtatttttgtaattttttgcttctatctctgcaagtaataactcaacattgtcatcacatgcaactaaggtaaaatgaggtaaactgctctgcagtgagttcttctactcagaaggcagtaggtgatcatgctggaagtcacatgatcaaggctgcatctcccatcatccctcggggcagtgatatgggatagtgggtctctttgaggactttcaagcctgaggggggggtggacaacatatgattcctagaaaaaggaggaaaacaacacataagcaaaacaaaacaatgagcaaaattcaagctaggaaaatgagtcaggcatgtaaaacagcatggtgccaaaatgattaaaaaggaaaaaaaaaaaagaaaaagggggacgggggaggggggaggggacatgctacagaaggaatgatttttaaaaccaaaaacaaaaaaaccaacaaaacgaaaaccccacgagataaaagtcttgcattatgaggaaggtcttcaaagagactgttgcgaatgcagcaatggtctagctaagttctgcaaacaaagctcagcagaatcagagcaatgctgcatgtttcaccgtgagacgccagagaggagaggcaaccgggcggccggggcacttacattgctggctggggtccgtgtccgtggtcaacttcacgtagttggacgggaagagccccacctgcccgtggacttcacccttccaccagtcggggtcctccttgttgaggacattgatgacctggcccttgctgaaggccagctcgtcgtcgttctgcgcggtgtagtcgtacatcccgatcacctggcacactgcgggagacagggcgggtgagcgggagggggcgcgggctgcctgaggctctccgggcctcccgtgtcccgaccgtgtccttgcccaaagagggcagagctacctggagggctcggagggctctgtctaagtgtgggcagtggaggaagctggagggctggagaccaagacaacagcagaatggcaggcctcacctttagttcccatcccgtcttcctcttgcatgtgttccgctgtccgcagaaaacgggcaggggtaggggagagctaccagggaatcatttctgtttgagggtggtgatgttccttcaggatgctgactcggaatgttagcccatctgcacacactgctgtggatcatggggacttgaacccagctctttttttccttttctgattttttgttggattgttttttgttgtctgtttgtttttttaaggtggaaggtgattaccagctgacctccaagaagttcaactcttgtgctcagctgtgtccgactctttgcgaccccatggactgtgccctgccagactcctctgtctgtgggattttacaggccagaacgctggagtgggttgccatttccttctccagggcatcttcccgacccagggatcaaacccacgtctcctgtctcttgagtctcccgtgttggcaggcagactctttaccaccagcaccacctgggaagctctcagtgaaaaggaaaaccagtgccttattctgctgtgcttttgtgtctcagaatcttgtctccaagaagcaatttccacattcaaggacaattctccttttctcattttccctcaaacctacaggaggttacacagcttttattccctgacatttttacacttcagagaagtctgcctagttaggtgttacccctgttcatctttcctgaccaacctgtatacaggctcaggctttaacgatgttccagctaatcccatccccttggcaaacaatttctgtgggttttaaccaacctgatgaagggcatgccactaggcctccccaagggagaggagacccagtgggcaccacacccttctgcctacaagagaggccatggctcaagcacgggggcccagctggggtcagcaatcagtcacaaagttgaccaatcctttcatttcttgcaaaggctgccaagttttgatctgatttcactggggatgtacagcacagacatttagccacaaggttctggaaggaaaagcctgtgtttccacaaataccacccaagattccattaatggcttaaagacccaagcagaagttggctgcccttatctcaccctctcacacattaccgaagcatctaatttggtctcttcagtcagaagatagccaaccatctcagctgcagggccctctgttccctcttggtccctttaggagagcgtgtataacatcctgcccattaagcgaagcccctctgttcacaggaaatgtcacaggggagctatttcggtctttactgagcagcacatgacaaccaacagacccctgtggcctctcggctcaatctcctgacctatttagaccccggccatttatttttaggaggccctttttgtctccccccaaccccccaccgccgccccagcccaaatcccaatttaaatagttggaaggaaatcaagagaaaaatctggcttcaatagcacagcattcagggcccctttaggaagccagttccaacaaggagtctgttgtacccagcacagcaaagctgcttagatatttggtccttttgaaaaacatattccatatcacattcgtggggtatcagcccctccaagtacaagaggcggttacagccgatgtgaaagacaactttcgccactccacaagagaactgagtaggagggctaccaggaagcacagaccattttctgagcagagtgtaaaccgctcacctgttgggaaagctgttggcttcggtgggtctgttggagtgattttgcttgtcccagggcttaaaagtttgacgtaattagcaggaaaccagcctatctggcgctttttcccacgtgcctaataataaaaaaaattacattaaaatgtttcaaagcttcatcctctttcatggtgtagtttgcttctgaacatggtgtgcttatgccaagcttgctgctgctgctgctaagttgcttcagtcgtgtccgactctgtgcgaccccgtagacggcagcccaccaggctcccccgtccctgggattctccaggcaagaacactagagtgggttgccatttccttctccaatgcatgaaagtgaaaagggaaagtgaagccgctcagtcgtgtccgactcttagagaccccatggactgcagcctaccaggctcctctgtccatgggagtttccaggcaagagtactggagtggggtgccatcgccttctccgtatgccaagcttacgcataactaaaacagaataacatcaatagactctatggattgctacattacaaaacgaaaacaccacagctgaaattcaaattgtggcagccattggttggcaaagcccggagtattttcctacgagctcgatggtgtgggtcacagtcagaggacaatgcagcacttacaggacagaaaaccctgcttgctgaacagctctcagatgtcaatttcaggtagggcagagattatggtttatgccaacgttatatatggattttaggaataataataataataatggcagtaacatgtactgggagcttcttatgagctaggcctgtgttaaacatctatcatacatgtacctacacaacaattccagaagaatactactactacaatttccatttcccatgtcccactttcactattcccagttctcagacaaaaagagtaaggctcagaaaagttaagcgataacctcaatgttacaggctagtcaacggcaagccaagattcacactcacatctatgatcttacggatattaactgtacatataccagatgatggacatgcgatatatgcaggatacaagggggctaagcttgaccttgccttcgaaagccatcaagcctgtgtgacagatgagtcatgtttcccactgccagtcctttctccttcactttaatctaattcaacacaaaatccattcattgagagcttacatgctgggagttgctggaaatggatagtatgtgacttgaaggaacttataataaagttggtgaaccaagacttgtaatcctgacataattctaagggacaaagactctaattagggatgataagtgtcaaaactacccttctgcacaccaccatgagcagagagttcaaaacaatttacagggcacacacgcacgcctcccctctaacctactctcaaaataagaaaataaaattcagagaaaaggaagctttccatacctcacccttaccctcttatctgatgcaatctgtcgtgaaggatacttctaggttacttttagaaagtagatcagattttactttctttgtggtctgatagacttcatgctcttggctcaaggactaaagcttttatcttcacactgaacccacccatggttgaagccacttctttaaaaggtcccccacgttcatctatctggtaaacactgccgtggggctcacagagacaccaccatttcccgcatctgtgcagtttcccaagggcagaacacagaactcactggcaacttctatttttctttaaaaaataatttctgttattttttggccatgcctcttagcgtgcaggatcttaattccttgaccagggattgaatccgtgtcacctacaggggaggtgcggagtcaaccattggaccaccagatgacgttcccaatttcttcatccgtgtagtcgcagaagacaaagtctggtgagagcaccagaagccctcctgggcagacaactgagggttgcaaggaccctctcaagactctttcgcgtaaggtactaggagtgagaggatgaaaaaatatggtttctgccctcaaagagttgataacctacatgaagaagaaacatgcatgggaagctaagtaatagtattggcatcaatactaaatgtcaagagaagctcaggcataggggccaccagggttcacgggaagatgtcgcctcgggtaggacggtcacagaaagcttctggaagaagtgggttctggccagctcttgaggaaggaggtgggaaggaccatgtggggagatgctctgggcaaaggcaggaagaaattggggtctgaggctgctgcttgtcttcaggagagtagatcaccaaccgcggctggagcagagacgtcactttgagagccagatgggcaagacgcatggaagggcaacagggcacacctgtgagcaggctgaggaggagggccacggggacccccgtaagtcttcagaacaggggagtcatctacgcacaggaaggccactaggcgacagctctctccaagaaacgacaccacaagtctgcggaaggcctcccccacccagcaaaggaagagacattaaataggggagggagggaagtcctggcagtccagtggttaggacacagtgctttcactgccacggccctggttcagtccctgcttggggaactaagatcccacaaattatgtggcacagccaaaaaaaatcagtaaatttaaaaaacaaaaaaaattttttaaaggatgaggggagtggattccaggacctcaatggaatactgaaccaataaactgtatcttgtccgccctgctggacgggttttttaatggctgcccaccagtgagatcccaggggaagttctgcctttggctactccaggctgtaccttctattccagccaagatacctttctttcagtccaccagcccactcttcactctctggcactttagtttctaattttaatctgccccatatgcacagaaagtgctgtatttatttatttcaccaaaatgtagatctttgccttcctgatcaaggtttaccttgacagactgatgaactgaggacggacacacagacacacacacacacagaagaactaaaactgtcgtgccacacagatgtggctgtgactacacaggccactgtggcgtcacacctcacagcaccgcggaggggaagctctgctcctgtattgctgtgacagtaaggatgaaactctccatcacgagctctctccttcccaccactcactgtctcaactcaagaatccagcagatacacatacatcttcaaaagaatcctcagctctcacatttctgttcctggctgcccaaggcttaggaacaaactgggtttagagaacatggcatctcttgttacacaaatgcaggattcagacagtgtgggggtatctgcactttgccatgaaatagcatcccttcaaaatcttgcatgctgaaatctaggcaggggattttaaacaaatggaaaagacactaacctgtagctctccttcccaccatccacctgggttctttttccggatcaggatcagctgaccgggggccagggtaagctgttcaggacccgtagctgtgtaggaggcaatgacctgcgcgatttctggaaaacaagaccaaacatggtagagtgcatcgttaagagtcaggagaaggacagccaagacacagccacctcccaggttcacaggtaaacgtcctcaaagccagcgcacagggccggttttctactcaacgaagaaggccccgtgggcccccattccccgcaaggcaaatgcagtgctccaggactggactcgccttctggttctgcctggtgtgcccgagggtcccctcatctcttggaacccaccagcttgcccccacaaattccccaccccaccccctccccctcaggatgccaacagctgagcctcatttagccccacccgccttccggcccccacacagggcttattattatcacacggtccacagaaggatggttgagtgaatcaaggaagtcaagtgaagccattccacccgccagaacagcagaaagacaaactgtgttcttgagaagccaccaggggcaggcactggcttgacttctacaccatgactttcctcagcctctctcttccgtccacaagaccattccctctgtggctgacactttaagggcgatccctgaataccagctagggatcacgtcaacggaagtttacttctttttattgcaagttaaaggaggatcctagagtcaaaagggggattttaagcaaaacagcaattccgcacagaaaaaatgaaaacagttctgtacttttcctgactgaacagtttcatgggaaaaagtccagcagtaccacagaccaggctctgaaaaagtacacttctcctggcacaggaggtcgactacgaaaggacaaaacccttctctgactgaattctggcgcatccgcagggactaacttgtggatttctagatgcaagacggaacagactgttctattcctctacactctctccccgtcgtaactgttctcagaagaaagagatgaagacacaaggaatgaagtaaagacagagagaaggagagaagtagaaggcccgtctctgacagcatttcctgcattaaggaacataacccgggccctccacccacccgaccctgtgctgtaatcagcggccaccacgctaggagcactgggacgtcccggtgcaggctggccctgtcagacgcatcccagaactcagggaagcaagagagagcccagctcactcatgtctgggctcccctgagagcccaagatgggaaatctgcgctggggacgagaactctcccccagcccaccaaggattagctctagactccaaagagttctcaattcagaaaacatccaaattattaccctatttggcccccggtgttcccattgctcaaaggacctggcctgtgtagctggtgacctgcctcaatactcttttccttttttttttttttgagcagcttgctgatttcagtgcgatgttaagcccctctggaccctttggaatgaccattcaaaatgtatagggttggccaaaaagttcatccaggttagcctgtaagatgcgatggaaaaacccaaacaaactttttggccaaccccatagcatactcagggttaaaatagagatttgactggggtggtctgatatcttgagtcagtctgaaatcctacaactaccgaaaaacccacttttccttgtcaggtgagcctgtctggaggctgagcgccaggcacagatacacaagtccctctctcagtgctgtggtgactctcaacctgtaatttctcaaggctgtaatagcaaaagggctcaaatgacctaggtgaggaagacaggccataccaaccgtatgatttcccagctgcttctttcttctcttgttcatgtttctattaatagaacatgtgatttttgtttaaataaagtgaaacacttttgagttcagggggatgactataattttgtgccttcactgtgtacctgaggaaaactactcaaaagcttctaattcataggccccactgtctgataatacgtgcggctcctctaatctcctccactatttacatcctgggactgaatatgcttcaggaaaggaaaaagtactgaacccaatgagagaaggatgaagtagcagctgaccccaaaccctacagtttcaagcgtgacaacgtctcaccatcttgcctgaattatttcttcacatcccaagagaacattctgtctgataaatgtccctaataccccatgtgtgaagcaacagccattatttcataatcatggatacacattattaatggattccaaggaaaggatctattccaaccactcttaggacagattctttagtctttacttttctttctttttttttttccaaaaaggtttctagccctaataaaagattgggagcaactatcaattacattaaaaacattgaaaaaataatcatcagggtttgtcacttaccaggtttttttcctaaactccctgttttcccagcagttccagagcccttgaaacagagcagaaggtctcatttgcatactgaagagttttggtcaagcaacttaaaaaacgatgaatgatgtcacgaacccgcgtgagcccctaaattcctttttttcattctggagaaacacagcagcattttatctcctggcattacaatgtgtatcaaggaaaacatggggcaaagtaagtactgtaaagcacacagcctttactctcttcttgaggggagaataagcagtggcactgtacagatcccccagggcgcgggcactgactgtgtgtaactcgagtgtggcctgtccccgtgtcaaatcaaacgggggctgccccaccaggagactgccggtctacatcctaaacactaagctcatgtttgatgtccaagtggttaattagcaaacatttcacagacaaaaagtacagaggttacagcagacatccatgagctcgataccccgacttagtattttatatatatatatatatatatatatatatatatatatatataacgtgaacatgttaccattttagtacatctgctttagggctttctttttttttttttaaagaaggaaaacaggatagtggcgattcaaacacccctgccccccattctattatcccaagaggtggtcactctctcctgtgagccctttctacctaaactttacactgtttaaacactaaaatttctctcttaactgctggacacacagtgcatagaagcagaccattttttccccaacttctaagtgttccaaaagtgctctagggttgaattccttcatgaatactcatggaattttaaactagctgagcaagccaagccggcagagacttggctgggacaagggccaggccgtaatctgtcgttacaaagtgctttattccgaattaattttcactcgtgtgtcactatcttccagtaaattaagtattccaattaaaatagaacaaagcgaacggcttaattaactaaatgagagtaactgtaaaataaaaatatgtaatttatctaccaggaacacaacttcttgttgtccctttatttatactgaaattcaataaccatctagcagggaaagttcaaattaaaatgtttactctgattatgctttctgtattaacaaagatatatatataaaatacccatctccctcggaattttcataggctacgtatcaacatgaaggcatactaatgctacaaaattccaaacggccagttaatttcccattgcaggcttataataggctttctctgttctataaaaagaacaaagcgattggcaacccagtgatggagttccagccactttaatgtgctcccttttaaacaccacagccagcacttaagctgagacagactcagatggccatgtttggctctggcacttctcaagaatgcagtagaaaagctgatccaggcgacatgccccagccctgctcgtgcagagaagggaagcaggcttaggacaaacccctctctgcatccatgggtcaattctggtatctgaggctcgggctggtttttaagtttggcatgatattgccttatgcactgaattctatgtccaagtaggatgaaagatttttttagattttttcattattatgaaataatgtagctagatgtttgcccaaaaatcattagcactgccagttcttcggtggctgataatttaagacgccagttaaaaaagcactttaaattcaacttacctttagaaaatgtcacagtgcattttttctaaacttactgacttgggatggtttgggtagaaaactcaagtttattaaaggataatacaagtaatggctttggtgtttaattgatctcaaaggtaaagccactttaagagtttctgtgcatgggagcagaaattgagtttagtttgtaatgttttccctctgctctcctaaaatatcatctccatggttcttactggatctaactaactggtctggataagagttgaattttccctctcctggtcttcaaaggataatacaatgactgtcttacagacaagaagtattttcattccagcttcagccaaattctccaaggggaagcggacttatgcaaacccctccaggggaatttcagcaagctgctctcaagaccaaagcaagggaaaacaaaaaaccccccaaacaataataatactccctaaaaaaagaaaaaaaaaaaagccaaaacaaaaacaaataaaaatctcaagcaaatacaaccactccagggaactgtagggaagcagagaaggcagactgaagggggaatcacagtttatcaccaggcccagccttgcaccccaagtggctatgggtctggtaaatggctacctttatgacctgaaattccccctaacttgaaattggccactaggagatgggctcccatacgccaggaggcccgtgccactatttcattaattctgtatcatctcaggacgacattttatgcaactgaatttttagggcccaattaacaacagttgggagccacttccaatttgtaagcattgaaaataaactgagtctctgctcaatctctgatcaggagataccaaggcctggccaaaggccttagtgaaatcttgtgtcttgctattgtgtaggtaaaaatataaattctagcagtaaacatgatttatatacaaattgtaaatttatccaactaactttttgaaataattccaacgaatcggagctgataggaacaaggatatccaaaatttatagttctgagtccaacctgtaatagatttccccctattatatagacaggtggcttccctgatagctcagttggtaaagaatctgcctgcaatgcagaagatcccatttctcttcctgggtccagaagatcccctggagaatggaaaggctacccagtattctggcctggagaattccatggactgtatagtccaggaggtcgcaaagagctgacacgactgagtgactttcactttcacttttcatacagacaggacttcatcagtcttgtatttatgtgggtatatttcctaaaactctacaaatgttattaatacatttttaacctttggtaatatgatattacaaaatagttgcttttcttctggtactgttcagctcagtcatcttcacatatgcttaatcctcataatcacttgtattttttcattttcttctgtcttcccttcccctgaatatatcaatgtgtttgttacagatttctaagaactcatttatgactaaggatgttaaccacctgttatgcaatgcaaatgagataccatattttattgctttcagttcactatggtgatttatattttggctgtgtattcaagtataaccatgttgtgtttcatgaaagataaataaattctaaaaactctctactacccaatattctggggctagtatcaccaaaatacatttgtttacatgggggaaatactgctgtgtatctttcttggggtagcccagatcagtgaccatggagacttaatcaagaacatttactctaaattctaagtcagttacattcaggaacagggaggaatcctgaacgttatcccagctgacgcagaccagcctcattcagggcagcctcctccgagcctgggggggttcttttgttgggggaagccgaggctgagcctgcagcgtcactaggcaagctcacacagcgacacgccacactgggtttgcagccacgctccagaccttagcaaaacccaacaacgatgttccaccggcgcacctcacgcctccctgaaaagagagtcactgcacagaaggggagaggaaacagttaatgtgggtttacctccgaatctttaagcctcacatagttagaagggaagacgccggacttgtcgcccactgttcctgtccaccagtcaccatctttcttggtaaccaaaatcacatccccttgctgaaaggttaaatcgccttgctcagaactctcgtaagtgtacatggcaataaattctggtggggagaaatattgagatacggagagagcttgattgtttacagaaatcccagacaactttgcaaaagcaagtttatgaacaaggacattaggataaggtccagtcaagagaaagcctagtcacagataaaacacagagttgcagaatcccctgggctccaaattgaccaacctgcatataaatttcagtaattgcagccagggagacaattcctgtgaagacccagccccagaaaacaacaacagcaacaaacctgcatgtccaccaataacagtacagacactgatctccaacttaatgccatgttttctttttacttggcatttttatatttactttttttttcttcaggattaaaaaaaaaaagtgcagttgatttacaatgttaattcccgctgtataacaaagtgatttggttatacatatatacaccttttcttttaatgtttactttgaattaacatttattgagtgcctaggttgtgccagtgttagaggcactgacatgcaggctctcggtaagctcatcaaatatctgtaattcactttttgaaggtaccaagtcaccattttagaaaacttttcgatgtggtatatcctttatgtaaattaaataagacacttttcaaagtgcctcggtgaaaacctaagtccttttgtgccatactacacagatggcagaagctgttagaacacataattttaaatatatattatttagttaaaaatggacatcacttgtcattcaaacaggaacaggtagaatgggctgctgataaaaatagtatctacccaaccccagaaaataatcacggctttctgaacaagatgaaaagacaaatcaccgtttcttacatgttattattcatgtaatttagtcttaaaggtccagaattaaagttctttactgtcttgaaggtgaaggctttgcattccagaggaaaattttcttctaaaacccctgatttttctaaggcttagaaaccaagtcataatctcagaaagatcacttgacacaaaattctagacactatactaggtacagaataaaagatttctagcaagatgaacatacatttcctgtttctactttttctccattttatcccaggctttttaaaaaaagcaattaaaaaaataacaaagtttacccaaagtgtttgttttataacagatggtgtgtttctaaatttcttatgatagtccttaaatgcagagcttaatgtcaattaataggcagagatttagtctggagcactccactggctaattgtaagagcctttgcaggaggcactaatggaaactaaaataaacactagcaaacacaaactatcctgatgcttatgctaatgtgggcagctctccaaggggccactccagcctcagctgaggccagcagacccccaacatacaaggtcatccaaacacgctagggggaacagaagcctctctgtctttagccctccagcaccggtgacacacacctccaccgttaaaactggcaaaaggatttcccgcacaaggaaatcaaagtttggcagcttgaataaggacactgctttttcattaatatattcctttttctgatttctcagtatttcgaaccttccctttttattttgttcttttacttgttccttagctcatgtctggccatttaagatcggatccttggccatcagtccttttcccagtgattcctgcacttaaaagtcactttcttaagaacggatccaaattttgaagtcacttttgaaatgcttaagaaacttcataagcatgaactctggctgaacttcacactgcagtagaagataccaaggagactgggaagactgtggctttacaagccctgcatgtacacgggcatctgtgaggaccttcaggatccaatgaaagtggggagacaggaagacagatatggggggctcctcactactcagaccctcctcctcagacatgtaacacagggtactggccattcccaagcccatattttaaaagctacccaaactgaccatctatttaatttggtttctggtgtctcagctggtaaggaatccacctacaatgcgggagacctgggtttgatccctaggttgggaagatgccctggagaagggaaagactacccactcccggattctggcctgaagaattccacggactgtatagtccaaggggtcgcaaagagttggacatgactagctgcctgaatcactggttactttcaatctgattacatttaatacagtatttataaacacatccctaatatatctaagtgccttttcctagaatatcagatgccatcgtcctcccatacccttccagaatccagaaatctttcctaatatttctaatactgaaatcactgtaaaatggatgtaataaatgagattagacatataaccctctgctgttgcccaagttaaggatgtgggtggtccatctgtgacctacttatcgaggcctcaagcatggaggcctctacatgtttcaaaacaaagcagcattcatcaacactgttgtcagatgaggacgctcactgctctaagtggctccatcaataatctaggaactgaagcaaaaaggaaataccagcagcatttagtgacctttattctaaaagcttacactattgtctcatgattcccatgataatttgctacctcaagtggcgattattacgttccttttacagatgagagagttgaggcatgactaaaattatacagtcactaggtgtgagagccaggatgcaaactctggcacaccactgagacgtagtggctgtaacctactgaatctgggcaggggggcagggagtattgcttgacacaacactgactacatgagctgtgtttaaaagaccttttgaaaaaaaaaaaataaaagaccttttgccttgctctcccaacagtggctataaaaagtcattaggatgacaaaaatgtatgaagagaactatactaatgattgttttggtggtaatggcaaaaactggatacaataaaaataccagatgtatttagtgatgatgaagttttttatagctatacctataaactaaaaaaatttttttacttctgaaattcctcttgaaaaagtaactttgtcactatttgaaacatcattaaaccttaatccttgctttaataattctatttttcataaagcaaagtttctaaagaatagaagtctcataatggcaaacaaactaaagattctacaagtattcaaggaaacaatgaaacactgctacaaaacaggttagacatctgttctcaacaaacactgttcctacttctgacacggaaagcctgtctgacttgggtcatgctcactcttcaattagtgctctgataatggctagaccagatgtagcaaagacctgagatttttaccactagaacctgaattatgtaggttttgttcattgttaaacttatgccatatactggcatatgttgggtgggccaaaaatttcattcagatttttccatatgctcttataaaaacccaaacaaactttttggccaacccaatataatccaaaagatggtgtcacgaagtaaagatgggggaaacaaagcaattaattacttttgtaagaaacactcaaaataaaatttttaggcctaaataatctgttgtggttatttccatggaaaacagaaatgacacttctgtttcatttgggtacaaatggcactgatgctactgtgacagctttactgaacagcccagttatggccttaaaccaaaatacttatctgtaagtcagaaaaacagcaagcatcacaaataggctacagagatgctcagagaccttgatctttagtgactttgatgggcctctttcaagagtcaaagggcttttaattgaacatcatcagaagattcggtttttatgagcaatatatctgatcgtattttgaaaagtccctgtaaagtactatgactttataaggagctaaacctcattgtaccttcaggtttaatataatgaacgtaaattaaggcagattctttaaacatgaaatccaacctcgttttcaatgttcactctttgtattacataatcgcctccaccgtctaaagatcttaatttcactcaagttctcaccttctcccgacacggctggcttggctgctggggaagctaccctctttagacttgcaggactttctgagggaccagaatccatgctggaagagggaggggaaagtatttgaattttacttttcatcctcaaagaaaacagtacaaataacaatgatactttctttttaaaactgctttaacatttataattatttttttaaaaagtagttatttgtccaggtcttgattgtagcctgtgggatctagtttcctgactagggattgaacctgggccccctgcatcaggagtctggagtcttggccaatggaccatcaaggaagtccccacttcacatttaaaaccttgataatctacagctgaaatagatgcactttgctaagtcaaaacacatcacaaagggccatggtggcccgactctaagctcacatccttgtctgtcagcactttgctttgctagatacacagccaaagcactggtctatttcaaagtacgacggacatgctcattcagtatttttgaagagattctcttcttaaaactcttaattcattgtgaccatctatttggttagaacaatgaaacaataaccttcagggtaaggtttcacaccataaggttcttaacaaaaaaaataattcactcttctaataatttcccccagttctttgggcttctaaatatttgtggatatctggcacagtaagtgaagtgaaagtgaaagtcactcagttgtgttcaactctttgcaaccccatggactaggcagtccatggaattctctaggccaaaatactggagtgggtggcctttcccttctccaggggatgttcccaacccagggatcaaacccaggtctcccacattccagggggattctttaccagctgagccacagggaagcccaagaatactggagtgggtagcctatcccttctccagcggatcttcctgacccaggaaccaaactggggtctcctgcattgtaggtagattctttaccaactgagctatactaagcatgaagaggaacagaatctccagcaaacccgcgagactgtcccaggtctcagggtagaatttcctcttgcacaagtcaatgaaaaacaagatgcagaggcttctgggtgaggaacaaatgaccatcatctgcaagaggctctcttctgttgacacatgccctaacttctgcagtgagaagacccagaagacgaaatgatccagcaactcctatctgtgaatcctaactagtgcaaacaacagtttcatgccaaacacggcatttgtccagtggaagcagatgaacacaagcataccttgtcgatttccttatgggccctgaaatgagtttcacgtaggacttggggaaccaacccttctggccttgaacttctccaaaccaccacatgtcttgctgctccagtacggtgatgacgtcgtttttgttaaaatttaaatggttgtctttcttggctctccacggatacagggcttgtgcctgtagcccctccaccttttcacccttgtgtggaagaacataaaggacctcttgtcactttgtgatctgttatcagttcaggtgctgcaaacaccatcaccttccctcccatgggtacatgcgggtacatgtgcaaccacagaagacacccccccgcctcctcccctccccgctcccccgcagtacagcatggctgccacgtgccccctggttctcaatagctgtttccttcccaaagtggaggtgaaaacctgccagcctgttcacaaagccatggccggcccatctagaagtctctatttaaagcagctaggagatcatatttattctgttgcacctggccgagtgccttttctattttggttctatttttaattctcaagttgcccagggcaatcccattcccgccagtttccaactggatttggatgtttagtgaagggttaataccaaagcagaaaccttctgaaagctcaaaaggcaagcaactcatatcttagtttaggtggacacagggaaacgggtcttgggttgggttgggcttgtcctagctcctttttaagacaaacaggggttgggcaagcataaactctctgtaatcccatgtactatagagctatatgaaaactctatatgaagatgaacagaatgccatctctgcctccccaaaataatccaggttaaaatactttattaagcagaaagcatgataaaaatgggcagtaggacatggccaaggaactcatgactaatgaagaagaaagagatacaaacaatcatgtctaccactgggcagaaggaaatatgctaaaaagaggttgcaaccattcatggtgggaacagagagaaaagatggatgaaagctgcctgcaggcaacagggcctgtttcccagaggtggcagtgtttgagccgggccttgaaggacaagaaggattttgatagctagggcttcggggggagtgaactccaggtggagggcacgaccgtgagatgctttcctgccaaggttcgaggaggaggagcaggatccgggggtgcgtgtggcctagtctcatggaggggtgcaataggagatgaggctggaaaaggcagggggaggcatttattatctcttaaaagactatcacataaaactatcacagtatattaagacaatactattataaaaaaatatgccaactttcgattatacatgtattcataaatgtacaagaacaagggataaagcccaaggacagctcattcagaaccaagctggacttgccttcagaagatacttattttcataatgacatttaactatgattatgcctgataagagagaatttatgatagattgaagagtttcggctttcatgctggcaactttcaactcctggtctccatgggttctcgtctgctcagacccatgacatccccatttccttccacctcaactgtccactcggtccagtcttcagaaaagaggagggttctctggattgcaaacaccccgaggaccactgcgtctccacctcctgtttctccggtcgtgctcacagggcgcttcccacctgggccgcggagctcatggcttctgtgtcccctaattttccatcttgtctctgcaatttcacctgggccctcgctggtgtatcgtaacctctcaccctgagacatcttggctgcacctgccctgtctccacctcccacacggagagcctggaatcaggcagaacacagactctgggttcagaccccaagtccgtcccttactaactgtgtgacctgaaacaactgctcagtctctcagctgtaggcctctcagctcatgcctctcaactgttcactctctcagttgaggcctccgtctccacatctctaaaacacagacactttcttcaagaaaatttaataagctccatctgcagagctgctatgagagtaatcattataacaggagtagcttctattactatcagttcttccaaacgatacagtattgctggagaaagccaagacaacgtgtgatgacaagtcacagactcaggttaaattcagccaagtcacgcttcatccttctttgctcaattcctattctgcatgccccgcaggccctgggggcccctcctgagaaagccgcctggaagcacaacctcaacttccttccctctttctccaacctctcttcaccctttctctcccagaaggaaaaaaaaaagcagcctgtgttttctctgcttgtaatgctgtttccccttagacgctcgacttctcagtctctgtttccactggccacacggctgctccttgtcctccttctacacggctccctgtctatcctttcaccagcccttcccactttcccacctatccttttctctgtatccctttgcaatctggagtatcctctttcccagatcacaaatacgtgccgcctgcctctttgtctggaccaccgcctttaataatacaagaactgccaccatccgctgttctggtcctgcgccctcctcctccacccgagtcatcactctgagcgtgacacatgtgctacctgccgagcaggacagatgcaaaggcaaagagcacagctcctgtccagagccgcccttctttccaggtcagagaagacacacgctgcgtgcagtttccctccttcccctgcagtctcgctcctctgaagcgctcacttcacttccttagatctgactgtgttcccatttcccagacaggaaggcctgactgtctcactctcacctggcaatcaatatgtcgaaaatccaactccctcctttcatgaaaagtcaatttctctttcggcctgacttgttcccccttaaggtcaaatctctcctcagtcttttcctttcctactcccacaggcgttgggattccacccctttaactgttgtcacatccctctgtgctcccccgtcgaatctttctgcacacctccacgtgagtcttcccagagcctgtgttcaagctgcttgttcccagagcagaaactgtccttgacccctaaatgcctgccagatgggcaatttctctgtttgattacttatagaaatgtcatttcttttatcacattaagtagaaatattatcctttcagcaattacttttcttaatgaggcatttaagagctttgcatttaatctgcagtcaatcttctctgataaatactcagtggtctggccacatggatggaccccatgtctttcccgaatcacactctggcctcctaaagaaagcctctctcctcagggcagtttctgtctgcatgccaggtctctccactttctaatcagctcttacctactgttcgagatggagttcaaataccacgtgatcagtgaagcttccctgaacaatccaggagcgtaatccagtttaccctcctctgaatagtcacgattccctccactgggaaaacgtgaactggatccttgcctgccagccatgccagatgcatataatgaggcttacatttttttttggccacactacatggcttgtgggatctttgttccccgaccgggcatcgaatgcaagccctctggagtgaaaacgaagcgtcccaaccactggacagccagggaattcccaaggcttactcccaatgacaatgacgacaagcactggctgaatctttcctcctcacacagcacgtgggggcctcccgctcccagcgatgctgttacctggcctagaacaggagacggagatgagcccgtggccgtggctggagtgaaggccgacctctgcctcagctgcccggcgcttggcacggtgagggagggctgggttgcccatgcgtcccagctgtcggtttctggtttctcattcgtgctggtgggccacctggaggggaagtgcaacggcgtgagcggcaaggacttccaaatgtgtcaatgctcctcccacagcagacacaccgcgacgtgcgtggggctagttcaagagcaaggagggggtaagagcactggacttgggcttgggtcagagcgtcacacactagtgatgggtctcaggcaaatgacagtcgtttctctgaatcctgatttccttgttgatcaaatgggaacagtactgcgctactctggttagctgtcagggtgacacgaaatcctacgtagggaaatactctgtaacctgaaggcaccagagaaacaccctcatgtgaccattatattcatttgcaacaacaatgctaaatcagcaaaaaagaagtttcatgtcacataggaagtcctgccaggctggcagctggtgcttcataacaccgtctctctgtcccagcaccacacagcaggcactgggccacgagcctggacaccatggtaaccctataggtggtatccttagagcaacctgttgggcgcagctcaggaacagttttaattttgtgattttataattgtaaataaacacatctgtgcgagttgccgattgaaatgcaatggacttttgagaatctttatgagagataaacaaatttgcaaatcaaagtatttcctttgatagacggcaggcacatcctgattctgggtccagaaataagatgcccaggaggatagccagagagccgcagatcacacatttattgagcaagagaggcatgctgcctagacccacagcaaaacgaaatcctgaaaagagtgtttgtcttctattttactgtcagctttaatttaaaaagtcagagcgttttaagggaatataaactagttgctatacataaaatagataagcgacatgattactgtagagcacagggaactatattcaacatcttgtaatgacatgtaacggaaaagaatctgaaaatatacatatatacatacatatacgtatgtgaatcactttgctgaatacctgaaactaacataacaatataaatcaactatatttcaatttaaaaaaaaaatcaggagaggagaatttcaatgtggtttcagtcacgctaatggaacactactttttagcagagatgagacagggaggagcttcttgagcactttcaatcttttacgtgaaaatacaagtatgaaaactattgctattcattatatccttccctctactttctcctgctcttggtcattacacaccttctttgctgtatttgatacactttctccagcattatgccccgactccttactttctatttgttttttctgaaagatgattagactttaaaacaaatttaaaacatttcttacatcacttttacttgaagggcagtataaactatttttagaccaacggcatagctggatcgatcctataagtgggagcgtggcagccctccatctgtcctttgaaacctctgcttacacactgtttttaatgccatttcctgatgaccaagggcatggcaccagtagctgccaaaggcacacatctctttgccttgctgtccgcttattcaggactgatcaaagaggaaagcctcagaggaaacagccttctatcttactcaaaaccacatgacaaaattcaatttctgtttctgtccagcaaaaaaaaaaaaaaaacaccaccaaaacagtgctatttccatgcaggaaatgactctaaatatttgctgacatgggtatcaagcagattattaggaaattgtgtttctccatttcttccacaataatgaaagatacagacaaatgagtgaatgaaacaagggtaagaggctttactttatcctagggaaaaatcactattaagccatgatataattaaatccagctcagagaatacaatccacaaattgccaaaagaccagtcagagaaagaggccatgaacagtactcaagaggtacaacccaaggactgaaacagcacttaaaagatcactaatgtgggatttcaaaaatcatcagaaatggcatccaaacacgtacgtggagctgaagtcggcccagttgttgggggtctcggagggctctgcaggggttgtggatgaaggggcgggggtctcacacacagccactttgggtgtaggggtggaggccgcctcagtcactggtttgactggggcgggaacctcattttctgggattttctctgcgtagtttgcagggaaccatcccgtctttccttttaattctcctccaagccatcccggttctccagtttggctttcgtccacctgcaggaaagtcataaagtttaatttaagtggaactaaatcaacccctacagacaccgaacactcttaacagaacaaagcccccatttctgacctggtcagactaacacacagcacagacctttctctgcctttttcttagtctgagagtctggaaaaatggtctctaaacattacctctaaagaaacagtaggtgctataattcaagttcttactcttttgtgcctgtttatctttttctttttctcctgataatagcagctaggaaaaagtgcctggagtcttaagaagtcccataattaaaatattttgagctactctgaattataaagtgatgtgacagacttcatcactcaggaactcaagtaattattaaaaagtaatttgacttaggtttattatttaaaatggaaagcaaagggtgcaatcaatataaatgtagccctctagaagtctctaataattaagcagtccttattccgcacacagacaagagggacagaaaacatagtcttagatgtttctacaggcaataaaactggctgtgtgtagtcttttgaaagctccacagatacatgaagagaaaattaaggaaatgattatttagagcaatgattaattttattaaagtcctattactttcttttgcataaattttactgtaacattcacaaatgtgcacaggagactacaggattctgctgtttaaaaatttcagaggagatttattacaattgggctttttatgtttccattttatcttaattctgactcaaaaggattagtcagaatcaccagaatgactctaatacttatctttccaagttatcctcactatttttgagcaacaggagatcaatttgaagataattacattccctagtagaaaattattttcattacaataagtcaaataaagttctgtcagagatcttatcttattttatcccgtaaaatactgtctcaggaaataaggcactgaacacttcattggacctgaatattgctcttttgaaatcacagaaatgagtgctagggtttcaacaatgactttgggaaaaagtggcaaaaaatccagttttctaacccattcaaatattcagtaaaacaaaacagagggaagggacatttgtatacctacggctaattcatgttgatgtttggcagaaaccaaagcaatattgtaaagcaattatcctttaattaaaaataaattattaaaaaaacacaaaataaatatggaaccacatatttatttgtattctgtgtagagtaatatggcatgatgtttattagcttatttgaattaaaaaaaaaaaaaaaagaccctgggataggcatggggaaagtagaattcagggcttactgaattatttctacatgttggttataaaataatccataggagagattccttgctgctctaccttagggaaggcttactgtcataggtaaaagcaacttttaaagctgagaagtctccaaaagagagttacccagagataaagcacaacactgcttccaaaagttctatttttggctttagagttccagtacgaacacccccacattgtcttctttcttcctcttctgggcagccccacgtgtttcatgagatgaggattcagagtgacattttccccacttggatcttattttctgctaagctaaagtggctagatgcccttcctcgttggttgatatttaccagtgacactacgacgcattgtaacttgctagctgctttgtgctggaaacatagctgtttgtaggccaggctttgccagggcctccccaacttctcagcttcaacagacaagctcctgccctttccgtgtgtcccaggaccgaggggaggatggtcagcagtgagtgaggagctggaggcagacacacaagcactttgcctcaagaccgcaaagtctcatgatcaagggtagggctctgccatcagactgcctcagttttggtgtttcggctggggccttgttgctgaggccttctctaggtgcagcccgtggaggctactctttgtggcagcacacaggcttttcactgtggtgcacaggcttagttgccctgtggcatcctcctggaacagggatcgaacctgtgtctcctgcattggcaggcagactcttcaccacggagccaccagagaagccccctgttgttgtgcagttgctcagtcatctcttgactcttggcaaccctacggactgcagcgcgccaggcttctctgtccttcactatctcccagagtttgcccagactcatgtccatcaagtcagtgatgctatccaaccagctcatcttctgctgccctcttctcctcctgcagcccctgcttcagttttagtaccacttctacaatttattagctggctgactttgggcaagtttaatttcttggtgcctcggtttccttatctataaaatggaggacaataacagtacctgttttataacagttgttaagaagtatccagaacactgcctggcatctgagatgtgcttgatgacagagtctcttcttttttaaagatctttcttgatataaactatttttaaagtctttactgaacttcttacaatattgcttctgttttatattttggtgttttggccacaaggaatgcaggattgttgctccctgagaccctgtgctcagacccacaccccctacactggaaggcgaagttgtaagcactggaccgccagggcagtccgacagactttctaaagccatctctcctgttgtccagctctgactctaccgtagttctcttttgtcctgcaaaagcctgggctctgtctgaccctggtcactttaggtaaccagagatttgggttctctatggggaggtccctgctctagaaacctgtctggtaccccaggcctctgggctggccttcctggcttcctgtaggggctggaatgtgatcccagatcccagcctatctgaaaccccttactggtctgtcctagttagacctccttgagtaccagctgctttacttaatgatgtccaatgacccgctgtcatttccttgagacacgggtcttacttggttaaccagatttttggctgacacctggaattggatctgaagccctgagggaatgttccaccccatgggcaggtcgagctcacatcctagttaattacacccagccctgccccaaagatgacagaaaatgagcaccaccattgagacgtgcctgtgtgtactcaggaagaggagagggtgccatgccagccccttatccttgcagacaagagcttctgctacccttcaaggcaataatgaaaccagcttgtcacttgtcaccaaggaaatccatcacttttaacctaggaaactgtttgctaattgaacaaacaacagtctcaatgaatttaatttattcttatagaaatccactaatttgaatgaccaattaaattttaaggttcagaggataaaataaaaactcacatttaacattaaattaaattaaccacttagaaaaagtctaaagggtcttgtatgaaaatgagaaacatttcctcctggagttgaaaagctttactcaaaatgccaaccaattgtgaaaaaatgttatctataattaggatagaataagcacagtcaaacacatagacttctttgtatacgtctatggttggctataacgtgaacatatacgtgcatggggtagattcatctatctgtggcttacgtcgatcacttacaagtgaggggatttttgtgctaataacattggtcttaatacaatttcgcttagccagcccactgtaacacctcaaagcatctgcagtcgttctagtgaaatgtcaaagtaggaagcacaaaccccaaatgttgcttaaaggactgggaatatgttagggacctcgtttatggactgttaataattaggcactgcataccagagagcactgaggcggcagtatgatgaaggcagcatcattaggttcaacgaccgaaccccgacacccaataatatcagatctcctttctcagtgtctatggcaccatgaccgccatctctgttaggtgacactaagatttccaacgcctctgaccttgtcacaaagaagggtagcagaggttctctctctcctaacaagcagaacaaaggctgtggacagtaaacacgtgtaaactgcgtacagacttagacctgctgctgccgctgcaagggatatgctggggagtatggagataagcacgtgcttcacgcgtttgccagtttggaaataaaagggttacccctaaactcctggatgaggatactaaagctgttttctagagacgcagccctagagaatggacttgtgaacacagtgggggaaggagaaggtgggccgaattgagacagtggcgtggaaacatatacattatctgatgcgtaaatcagttagccagtgggcattcgctgtctgacgcagggagcccaaccagatgctctgtgacaacccagggggagggaagggtgggaggtgggagggaggtttaagagggagaagacgtgtgtacacctatggctgattcatgttgatgtatggcaggaaccagcacagtattgtaaataattattctccactaaaataaataaaaaaataaataaaattttaaaacattaaaacaacaacaacaacaaaaaaccacctgttttctaaagtgctaatctagaggtcagccaaaaaaattttttttaaatatttatttgactgtgtctggtctgagttgtggcatgcaggatctccagctgaggcacgtgaactcttagctgcagcatgtggaatctagtcatggaaccaggggttgaacccaggccccctgcaccaagagcttggagtcttagccactggatcaccagggaagtccccttaactttcacaaggactcagacctgcaattgtagcacaaaggcagctgtaggcaatatggaaatgaacatgcctgaatgtgtgccagtaaaacttgattacaaaacaggcatggactggattaggctcactcttggaatcagtgtatactggtccctcaaaacagcaacggctcagatgttaaggttacagaaatctaagaaaggcaggaaagaaacagtattgactacattaaaaaaaaaaaaaattctccatcaaaagaagagaaaaaatgagtttaaattgttataagagtaacattaaattaaaagataaataattttttgaatgaatgggctggttgatggctaagaacccctaaagaagtctcttttttttttggatggttctaagaaaatgatatttttcagaatgacttgggattagttctgacagaaaagagattaggcaagatcagtggtacccaaaactccctgacagaaccaccagagaagattttgaattcttattgttcagtcactcagtcgtgtccaactctctacgactccatggactgcagcacaccaggcttccctttccatcaccaactcctggagtttgctcaaactcatgtccgtcaagtcagtgatgccatccaaccatctcatcctctgttgtcctcctgccttcagtctttcccagcatcaggatcttttccaatgagttggctcttcatatcaggtggccaacatattggagcttcagctttagcatcagtccttccaatgagtattcaggtttgatctctttaggacagactggtttgatccccttactgtttaagggactctcaagagtcttctccagcaccacaatttgaaagcatcaattcttcagtactcagccttctttttgaattctaaatatggattaaaagttcccagagtctctgggagagagtcctggattggttttttgtgtgtgtgtggcccagatggtaaagcatctgtctgcaatacaggagacccgggttcgatccctgggttgggaggatcccctggaaaaggaaatggcaacccactccagtattcttgcctggagaatcccatggactgtggagcctggtgggctacagtccgtggggttgcaaagagtcagacacaactgagcaacttcactttcactttcactttaagatccctgagcaggactgatgcattcagccttgcaccatttaaagccagctgagttagatgatcagcctgtgttcttaagataaacaaaatggcagtgagcagcactgttctaatctctcatgctattatttcaatacattgtggatatcaaattgggctttttcaccctccaggtaatgggacctccagatcagaagacaggccatagattttcagagtatctaagcctgagctgttaaggtcaactcaactaagatgcctccactcagaagtcttcccagcgcacatccattcactctgattccttttttcttttatattcctagcagcagtagtgagcattcactgggaacttcatcacacactggctttttcatgtgcttctccctatttttctaaaaagatttgaaacatctgaatggtagatgttaccttatatttctttgtattatcaacaacagttagaagaggactatatatgaaataccacctaatttttgttaatcatgaaaaaatacttttggagaaatctgagctgataatcaagattttaaaaagcaaaatattttttaaagcctcttgcaagactgcctgcattaaaacaggatacaagttgctagacctctaaaatctcaacatgtatagttagctatttttcaaagtttgagaaatatgagaacttgatgatgactatgcctacaaaaataagtgaactcctgattactcaaccaagagagattgctaaggatgttctactatgtatttttcacaactgtgtttcttaactacaaagttcatgaaataaaaaaactgttactcttacaagtcaatttccattttgagtgtccaattgttagcctcacaaagataacacagctgaatgccacttggggtgtcttgttgcgttctgtgatataaaatgaaggcaccactccagtcccttcaacaagaggatacaggatgcctcacaacaaagtcccttcatcacacatttgggatgtcggagataaagtaaacagtaacccgggcccgggtagacactctgttatatttgtcaaagtcggatttacctttagtgctttattaaaaatgataaatgttgataaagttgtaaatatgaatatggtggtggtggcttagtcgttaagttgtgtccaactcattgcaaccccatggacaatagcccatcagggatcccagtccatgggatttcccaggcaagaatactggatgggttgccatttccttctccagggatcttcctgacacagggattgaaccggagtctcttgcatgccagtggtatagaagtacacaaaattaaaccccgccccccactactgccaagtagtaaccactattaacagtttgatgcctacactgcgaaactgtaaactatatatacatataaacgtttacatacacacacacacctggttttttatttacccaaatacaattatactctatatattgtttctgcttttttactggagagtttattcgtatcaggttggccaaattgtacagaaaaacacaaacgaacttcgggaccaacccaatacatgtagatctgtgtaattttcgaaaacatctttattgtttagctgtattgtaatttatttaaaccatctcccttctgagggatacagggctgttcctttttagcttttaccagcagtgctgcagtgaatatccctggacacatttatctgtgcatttgccaaaaacagcctatagaagggagaataacagagttcctgggtcaaggggaatgagaaatttaagactgaataagcgttgccaaattgcctttcagctgccttagccaattcatatgacaatgctcacgatgtgtattatactcacttttctatactgttgacaaagctggatgttatcaaactcgtaaacttgctcagctgagagatgaaaaatgttatctcatctttaacatttccattttcctgatcaccaaagaaacatttttttgtatattttaaaaatgtgcatgtatttccttaaagctgtaggtttctttcatattaacttttcagtctttatgtatcatggatggcaaccctttatctctcatatatttcgcaatctacaggatttaattttgtaatattgtcaaatctttccatattggtcactgatggcctccagttttaacccagaaagttttttttttaataacttttaaaaaagaattttatcttttaagtttaacctacttattaacctacttattttcgcccatgttctgagagacttgacctgataatttgccaatacggagccttcaagttagtccttacatggaagctaaagcaagcagaaatctggcacgcaaacttttacacttttcttttcttcttttcctatttcaagcacagcctacatcacaaactcaaaacatctttttactgccaagacaacacccaaagatatgtgtacttacacagaattaaagtcatttaaaagaacaaaacatttaataagatacagacttcctgacagtgagaaggcactcacccattcccctttaacctccaccaggaaagcacaggtttgaaagcaaggcaaaacatatgtttaatgagatgtttcattcttacagtatatctacagtttattctttcagaggggctggggcttaactagttaatttaaggaaaaaggactcaatatcactgtaacaagactatgtttccttcaaaaatagcaatatttactcattaaaatatagatcatctgtaacatttccttatcataacacttggttaacacttccttatctcaaaaagagtattactttttctgcactttgtgctgcaacaaaatccagtttcaaaaatgttaggctttttttttttttttcttttgaaagcagtgtaaaaaaaaatcaaccttgtaataaggtcctatctgctacagcattgtaccttcatactgtttagattcctgctattgattggtatttagataaattacagttcatctgctttaaaaggcagcctgaggtcatcaggacagagaagatggggaagaagctgagaaaacactgcctgcctcgggtcaccattcgtgtggagggtgttctgtgaagaataactgaggctggtgcctgggcatccaaagctcaggttccattactgtgaaggaaatgttgattttgaaagattctggacctttagatgtaacctccttattcccagaccaaaagaactaaagaaaaagctatcagaaaataagaggaaagggcatcagcttctctgagaaacaaacacattgctccttctaaatattttgatccatgaaatatcacatactctaaatacagatatgatacataaatgcaaaatgaatgtatgagtaattactgtggctacacgacatcctttatacttcaatgacatagggtcccagtatgggaagtgtgtttgtctcaattattaattttcacagttctttgaaaattctgaaccatttccatctttaaaaaaaaaaaaaaaaagccaacagtaatgcaaagtttgaccacttctaagacgtacattaactggattgaggaactactgatttcttttaggaaagaattcaggtcaaccacattcctttattctttctcaaactggttactattgctttagttacaatcacaagattatatttaattattttatatatatatatatatttaattcttgtatttaaagaaaaaagctatgacaagcaaaatcctgaactctttcatctgttcatttacagagtaggaaagcagattaactgtatttagttcattactcttcaggcaattcaaagtttacatgagtaaagggaaaaaaatagaaaagttatcactggcaactgtgatcagatactttgcatttaaaactatttctgaacgactactcatagtatctcagtaagaatctaatctctgaaattagcagagctttacagatttgaaaatacagaaggctatgtcaggaacccatttttctttaacaattctattttaaggtgatgcatttttaaatgctgtctctcattcaaatagaaaaggaagaagactgagtcagtacttcaaaaactcaaatgctggattactggatttcacactcgcccacaattttacaactgtcaaataaagtacaagaagaggacagatgctaaccatcaacagaaaccagactttcgctggaggctttcttaccatgactatatctcccggctggattgtgatttcatcgtgactcctggactcaaagggataaagtgctcggtaatacaccacttttatattctcctgtgcagaaatcgtaagtgggcctttttctgtttataaggaaaggaggggaaggggacaaaaatgaaatgctacatgggacagaaatgtatgacacaagccaaattaccgacatctatctcctctgctgtctgtcttcacatctgaaccacttccatctactcaaggaatttctggaagacattcagtgaggatgtgtctggttctgaaaccaaaggagagccaaatctgatgtcagcagctccatcccatctgagaggtcattagtggacgcgaatcaaaggttactgcggtgctaacgcccccgctctctgcctcctggcttagacgccagcagcgcacatctgtaaggcatcaagacctctctcccccaacgcagggtgtctagcaggatgcagtagactgaatgtgacgtaaatctcaaatcagtcaactcatacgggagggctaagaagcacaactttaactgcccctattaagtgatatagaaatgttgaggctgcaggccccatgcgtggtcatataaaaggtaagttaggaggccacttgtgttcaaagggcaaaaaaacattcaaaaggtaagaccacaactggacgcagtgcagaccaagaacagtgaatgccgcctgagtacaggccaggagaagaaataccaattcctgctgctgagacagctctgaaattcccagagaaaagaacacactggagaagcagcaggttcctctttggcaagaagggtaatgatctccatgtggaatatagctgtatgaatggcacttggcaataaaacttcatgccactgctgtctgcaaacaacttctggatgccagcataatggggccaagggtcgccatggtgtgggcccctaaaagagacctctaaactgatgctagataatgaacatctgcactgtccaaaaaatgactgaccttctcacggctatgaacgtagccaagacagagcctgatcagatatggctacttccccgaaggacttgggaggagagtgcttatttgctagcctaattctggtctctcatacctgcagtggaccagggtgcctggacagcgggcttagctggttcttgatgctggtggaaaagccgactcagcttgtcttgcatttccggtttgcccttctcctcactgtccttctttttgacgctctcctcccttttgagcttctcctcctcgtggggttttcgtggccgctgctgctcatcctcctgatgcacgcgctccagccactgctggtccctttcctgagctcgtctgtcaacaaaacgcctggttacagcatggaagcagctccatgttaatactgccgtgacgtctctttccataaagagctctatctagtcaatgggatgctaagcaccaagggatactgtttgttcttcaggtggacgatctgaatcaacaaaacaggggctctcagggctccccttctgggtaagacgagatcacatgatttagaaagacacagaaagaaaattcctgatgtcgtttataaagggattagagaactcaggaaaatactcctccatttaaaaactggagcctattatacagagtgaagtaagccagaaagaaaaacaccaatacagtatactaacgcatatatatggaatttagaaagatggtaacaataactctgtgtatgagacagcaaaagagacactgatgtatagaacagtcttatggactctgtgggagagggagagggtgggaagatttgggagaatggcattgaagcatgtataatatcatgtatgaaacgagtcgccagtccaggttcgacgcacgatactggatgcttggggctggtgcactgggacgacccagagggatggtatggggagggaggagggaggagggttcaggatggggaatacatgtatacctgtggcggattcatttcgatatttggcaaaagtaacacaatattgtaaagtttaaaaataaaataaaatgtaaaaaataataataataaaataaataaaagcatggttcgcaaaaaaaattaaattaaattaaaaaaataaacaaacaaacaaacaaaaaaaactggtatataactgcaaagaaaaataaaagacataaacacacaggaatataacttccatggacagaaagtatacccaacactgcaagtgaaagattgcttagagaagtccatgaacaattagatcatggagggcacatgcccgtttatgtagcacatgaatagctctccagaactgaaacagaaaccaagaggttattctgaacactggaggtagtaaccatcctttactaagcaacagtttctatcttttactgaatttgactactttgttcgtcaaagtagccgacacaaagagataaagtgcaattaaatctaggccttgaaaagtatgatgacctcagtatgaaatccataggaaaagactaggaatgataaatttttcttaccaagaattatttttcttgcattccacaacattttacaaaatcagaaaattccttaaacaatcacaatttatttatttttgtctgtactgagtggcttgtgggatctcagttcccaaaccagggactgaacgcaggccactgcagtaaaagcactgaatcctaaccactagacaaccaggggactccctaatgatcacacttcacttttgggggggcggggccccacactgcatggcatgtcagatcatagttccctgaccaggcattgaaggtgcagctcctgcactggaagtgtggaatcttaaccacaggaccaccagggaagtcccgatgaccacactttgaatgaaactaatgtgcaataataaattataccatgttattaataattagtcttccacatttaaaaaaaatatttatttttatttatttggctgtaccaggtcttccctggtggctcagatggttaagaatatgcctgcaatgcaggagacctggtttcgatccctgggtcggaaagatcccatggagaagagaatggctactcactacactattcttgggcttccctggtggctcagagggcaaagaatccacctgcagtgcaggacatctgggtttgatccctgggtcgggaagatcccctagggaagggaatgggaacccattccagtattcttgcctggagaatcccatggacagatgagtttggaaggctccagtccatggggtcacaaagagttggacatgactgagcaactaacactttcactttcacttccccaggtcttagtttcaggatgcaggatctggttccctgactgggtaacaaacctgggccccctggattgggagcctggagtcttagccactggaccaccagggaagtctccacatctgttaactactttaactctcccacctggtgctccgtcactcagtctgtccagctcttggggaccctgtggactatggcctgtcaagcttccctgtccatggggtttttcaggcaagaatactggagtgggtggccatgtcctcctccaggagttctctctgacctagggattgaacccgggtctcctgacttggaaggtgggttctttaccactgagccacctgggaagcccaccaggtaggcaggtcctaatcatccacattttacaaaagaggaaaatgaggcagagggagtgaaggacttggccaaggtcacacagccatacaggcctcaggattgacccaggccactcggttctgttcacaacctgaatccgctagccttgtgacacagccaaggcacaaaggtcattttgtggaatcaggaaacagccaagggaacataacataaacaaagagaactttcattctccatttaaaaatattatatttatttctactcgaataatcatgaagattcagtgcagtagaattcttgttagtttaaatcttaagcatttcagttacaattttcaaaacatcttttaagaatgctatacaaaacatttttttggaggggtaagaatgttaattgttattcataacacaacaaaaaaaacacaataaaatttgcttcacatatttcactaacaaagggaaccatgtggacacagtgagggagagaaagggtgggaggaattgagagagtatcacggaaacatacatattaccatatgtaaaacagatattaccatatgtaaaacagggagaatttgctatatgacacagggagatcaccccagtgctctgtgacaacctagaggggtggctggggtgggagatgcgggggtcgctcaggagggaggggatatgtgtatacctgtggctgattcatgttgatatatggtagaaaccaacacaatattgtaaagcaaataccttccaataaaaaattaaaaataaaataaagtatataatcatgtaatttctgaagttaaattctgggtactatttatcatataattgtacacagaaaatttaaactttccatatgatgacactgtatctttatttctactctgtagggatataaaattttggtggaacatataaataatcaactttatagataaaagaatggagctaatcaacacatccaaggggataggtctaggggcataatcctagacctagccccaagaaaaccataaagtagtcctctaaattggtttgagaccctacctacttacccactggcatgtaaaaacaaaaccaaaaacaccaggtgcaaaaattactatttcactagtaatttaccagatgcaaaatattactagcagatagaaacagacacaaatattcaaacagaaactaacaaaaatatgtctggatcttaagcagcagcaacagcaaattttctccttttgacctcaaatttcatttgctgttgaaaaaaggaagatggtggtgtacactattcaccccactggagaaaccctgtgcggccagtgagatcagggactttgatttcaaacccaagactctgatggttattgttattaaaaggctgtgaactggaaacatatgttggtcattggcatgcaaacaggcatatcaattggcccaaatccttgtgtaattccatttatctacataatcacaacctgagagatctctgagcaccaaccgaaaacttcagaggttacttatatacgcaaagatttacatgcacatgtgcttttgcttgttttgtgtttagttgttaagttgtgtctgatgcttttacaaccccatggactacagcccaccaggctccactgtccatgggatttcccaggcaagaatactggactgggttgccacttccttctccaggggatcttcccgatccagggatcaaacctgtatttcctgcactggcaggtggattctttaccactgagtcacacacattaaaaactgagggctctttctggttcagtaagaacttggggaagttcagcgaagagtagtgagtacctaaagttccttccagatgggttcacaatccactgaaaagactcacctttgggcttcttctttttgtttttctaattccaggatctttcgttcttgttccttctgtttcagtcgttcagcctctatggacttctgtttctggagctgctgcttattatgtatttctctaagttcctataaataattaagaaacagttcatgtagcaacatgtgttgggagacatttctactgtttatcagcatgcaacatttcataatggggaagcctgaacacgtaggagataatgcttcaggtttcaaagacattaacccggaaaactacagtcaccctacactgacatgtctgatctccagaagctgtttgaggtcttattttaggagccatgataccctgcaccacgtccatgaggtgttttagaaggagcttacgagggatgaacattagagaaactatactgctcaagacacagcaacaataatagaacacaaccaactttaagaatggtgatgactatgaacggaaccttaagattcttttgataataatcaacaccaaccttcatcggctctgaagatacacacatttcttcacacattccctccatcaaaccatgaaaacctcggctcctccttgtgacacgctgctttaaaacaaagggacatccttctccccaacaaccttgagtcttcccctggggtctattttgcttcaaatcagacatcttccagagcatcttttactaaaaccgtgaagttgtcagctgccccaaactaaaccagtagtcagatggaaggtaaaaacctataatttgaccattcctctagatctgatttcctcatgtgacactaacacaggaataacagtaatttcctcagaaggctagtgaaaataaagtgtatgttataatatagaaagtattcaagtcagaagctgaaataatcaaaaatatgaagaacaaagaaatgcctgttggtgagggaaaatcctctgattctataggaatcaaatggtcactaacagattcagtcaccaaatctcttcttgtgtcaataaaaaaatcagacatgcccaagtgtccagcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgccggggggggtggggggggggggaggggcggtggccccaggctctatttggtgcgatttaagaatgaagacctgcactgtcttctcttgctttgctcataggtaagtccatgtgaggaggtatattctggccttatttctacctttagagttaattcacagctcaggcatcaaaggcagaactctctggagaagatcaatgttaaaatgcatttattcctagagaaaagccctagagtgagggtaaccttttcccactagctaaactgttcttaagataaagttaaactgtatgtataagcattcagtataccataagtgacaaggagaagtcctaaaagggatccatgggatgtgggaaaaaagtgtaactggcgatcaggaggttagggggagcatgtactaggggaggagggagggatgaagaggaggaggctctccagagaaggagaaggacagaaagtaggaaggggcttcagtggagaacccggcggatgagtcaggaaatagccaggcaggatgagcaggaagatgcaactttgtaaggtcaatattccttagggcaacagccatgggcatgtgacttccaaattatgatgggtatctgggacagggggcttccctagtggctcagtggtgaagaatccacctgcaatgcaggagacacaagtttggtcccagaaagatcacatagagaaggaaatggcaacccaccccagtattcttgcctgggaaatcccatggacagaagagcctggcaaactacagcccatggggttgcaaaagagagacacgacttagcgactaaagaacaacaacagcaacttgggtctcaagttcagctatggaggggccatggaaggccaagagtggagactagaaagtgatgattaagtcttgctttgtgtacagttctaagagaagaaaatcagcaccaggaaaaaagaattccatttttaatcttctttctcatggctgtactatgggatataaaactgatcttgaatcaaacataaatagtaatctctaaacatatgaatgaaaaatctggttaatattcgggatttgatatttcagagacaagtggaaaacaaggatcaattcctgttaagagttgtttgcactcttggttcaagttaatatctctacgagaaaaggaaaaactgcagtggagtagtattaattgaaactctttatgtcctaagagaggaacccaaaagtcagcacacagaagcagaagatattaagaagaggtggcatgaatatacagaactatgcaaaaaaggtcttaatgacccagataaccatgatggtgtgcaatcactcacctagaaccagacatcttagaatgtgaagtcaagtgggccttaagaagcatcactatgaacaaagctagtggaggtgatagaattccaggtgagctatttcaaatcctaaaagatgatgctgtgaaagtgcttcacttgataagccagcaaatttggaaaactcagcaatagccacaggactggaaaaggtccatttttaattccaatcccaaagaaaggcaatgccaaagaatgttcaaactactgcacaatcgcactcatctcacatgctagcaaaataaagctgaaaattcgccaagttaggcttcaactgtacgtgaacagagaactttgagatgttcaggctggagttagaaacggcagaggaaccagagattaaattgccaacaactgctggatcacagaaaatgcaagagacttgcagaaatacatctacttctgctttactgactatgccaaagcctttgactgtgtggatcacaacaaactgtgtaaaattcttcaagagataggaataccagagcaccttacctgcctcctaagaaatctgtatgcaggtcaagaagcaatagttagaaccagacatggaaccacggactggttccatattgggaaaggagtatgacgaagctgtatatcgtcaccctgcttattcaacttatatgcagagtacatcatgcgaaatgctgggctggatgaagcacagctggaatcagttgccaggagaaatatcaacaacctcagatatgcagatgacaccacccttatggcagaaagcaaagaggaactaaagagcctcttgatgaaagtgaaagaggagagtgaaaaagctggcttaaaacccaacattcaaggactgggggtttaccttagggcttccctggagtgcaaaattaaagtctggaaagatgggtccccaaaggctcaactgcagcccacatggaagggcccctccactgtaatactttctacccccacagcagtcaaggtaccagggcatgacaagtcaagccatggaagaaaccagaagaggacactcaatatacctgtgagcccctgggagagttcagatacctattcaggactacagatgagtgccattctaatgaacacccccaaaattaagtttctggggataagatttctcaggctaggtctaatgagccaacacagcttggcaggggttatactccaaatcagacaggagatagatctcctgaaccctaaacaaggagggacttgagccatcttgaatgagaaatgttgtttctgggtaaatacctccagccaagttgaataaagtcttacagtcctcaagaaaaacattcagatcctatgggatctcaaagaacaagctggagagttctcggggtggctacaatctctttttaggggatccttctcccggcgaggggggatttggagttgaccagtgtccctactaatccctgtcatcaccatattgatgttgcttgtgattgctccatgtattatcaattgtctaacccgtttcatctctgcccaggtcaactagctacacaacatgcagtgccagttcaacaaagatatataaaactacacccgaccacggaaaatatcaatcacgcttagatggacaccgctaaaaggactctgaggcttgagactaatagggggaggcccaatgccccttgctgtcccagctcagcagggagtagccagagagatctcaatgcccctattgccaaagaactgggcctcccatctcttgacggggcaatgttaggtagttagaattggcaaaacgagtccaaaatggcgtggctaaaagacaaagaaagagaaaagcccacagaagtggaacaaaagaagatccacagaccatagtgagaacttcaggtgaaacaaacacgcccccttcttggccagcctaatttgcatagggcaaactcaaggggttgggggcaggagacaaatgtataaaaggaggaagccaagatggattgaggcctttcctttgaggttggtgtgccatcacaccttgagggtatactatcctgtttgccgaataaaactctggcaaaaccatgttgctaaaaaaaaaaacaactcaacattcaaaaaacaaagatcatggcatctagtcccatcacttcatggcaaatagatggggaaacaatggaaactgtaacaaactttattttcttgggttccaaaatcactgcacatggtgactgcagccatgaaattaaaagatgcttgttccttggaagaaaagctatgaccaacctagacagcatattaaaaagcagagacattactttgccaactaaggtccatgcagtcaaagctctgctttttccagtagtcatgtacaaatgtgggagctgaaccataaagaaagctgagtgccaaagaattgatgcttttgaactgtggtgttggagaagacttttgagagtcccttggactgcaaggagatccaaccagtcaatcctaaaggaaatcagtcctgaatattcattggaaggactgatgctgaagctgaagctccaatactttgggccacctgatgtgaagaactgactcattgggaaagaccctgatgctgggaaagattgagggcgggagaaggggataacagaggatgagatggttggttggcatcactgactcaatggacatgagtttgagcaagctccgggagttggtgatggacagggaggcctggtgtgctgcagtccatggggtcgcaaagagtcagagacacaactgagcgagtgaactgaactgacctgacctgaacacaaagagggatggcctgacatctcactggcccagtggctgagaccctttaaaaggaagggtaaaagatgatgaaaaatagaaatttatcctattttcaaagttcattttcaatcacacaaaattctcaaaaaggttcagaaaaaataatttatggtgtgcacgctcagcagctaggtcatctcgaattctttgcaaccccatgaactgtagcctgccaggctcctctgtccatgggattttccaggcaagagtactggagtgggttgccatttacttctccaggaatcaaacctgtgtctcctgcattgccaggcagattctttaccgctgagccaccagggaagcctgggaacgaagataacaggattttattctcaggtccctgatgtgggccagcagctgaagcagagttgatgatcttcagggttcttttttgtttgttttgtagttttaagatctattaaattcttagatactgttcatcaccataaaaatttattctaaatttatctcaatgtctcttttatttatgattttatttttacggcataagctaaaaaaaatgcataactagtaagcaaaatcggagaaggcaatggcaccccactccagtactcttgcctggaaaatcccatggatggaggagcctggtgggctgcagtccatggggtcactaagagtcggacacaactgagtgacttcactttcacttttcactttcctgcactggagaatgaaatggcaacccactccagtgttcttgcctggagaatcacagggatgagagagcctggtgggctgccgtctatagggttgcacagagttggacacgactgaagtgacttagcagcagcagctgaatcaatgaagaaacatgggataaataaaataaagtacaatgttagttatagaatctaggtggggtgtatacgtgggcttgctgtaaatttctttcaacttttacatatgattgaaaattttcttaacaagatattggggaaaaaaattttaaagggggcttcccacatggctcagtgataaagaatctgcctgccaaagcagaagaccaggaagatcccacatgctgtgaagcaactaagcccgcatgccacaactacggagcctgtgctccagagcccgggaactgcagctactggagcctgcgtatcccagagcctgtgctccacaaggaagagtagcccccacttgccacaactagagaaagcccgtgtgcaacaacaaagacccagcacagccaaaaataaataaataaaattatatttttaaaaaatcttaaaattaaaaaaaaaacccatttagtattttacataggaagtatgtaggaaatagtatcttcaaggtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttagcagttagcagtaagcaaaataattctgagctgaaattaaacacaaaagagtaaaaaatgacagaggaggaataacattttagtttgatgtttagggacctgctgctgctgctgctgctgctaagtcgcttcagtcgtgtccgactctgtgcgaccccacagacggcagccctccaggctcccccgtccctgggattctccaggcaagaatactggagtgggttgccatttccttctccaatgcatgaaagtgaaaagtgaaagtgaagtcactcagtcgtgtccaactctcagcgaccccatggactgcagcccaccaggctcctccgtccatgggattttccaagcaagagtactggatttgggtgccattgcctgtatattaaaatagaaaagttcttatttcattcaggaaaagtgtattttaggcatagtggtattcagaatatttaataacatgtaaacactacataagcaatagccaattaggatggactccagccatgatgtaccaatgcacagggtagaccataggcacaaatgaagatttttcattttactaaagaattatacggcccatttctatactgggctctagtaataggagatctattaatttatggatcaacaattaccaaatacaaagtcttgacagatgggaacaaagctaggaacatattatgaggcactataaaatgaaaagcaatcagaaataaatttaaaggagaaaaaccactctaacgagacaattttaaaacaatttttaaatgtatcaaatactcgaaggaagatatttaaaaaaattttaaagcacatttattttgagtataagagaattagaggataagctgaacctatctttggaactgtctaaataagctgcaacttcaagcacctccaatgcaatggagtttgcaggagccataaaataacagatgtcaaattaggtaacagaaggctctgacatcttatgatccagatttgaagattgagaagtttttctgtcatttccttcacccgagtcaaatactgctgagatacacaatcaaatataagaaaatcaagatgctatgaataggaagctgttctagatcttcctctttttcttggacttaagagtttaagaaggcatgaaccaaaataagcagaaaatgtatgattcctaagctgattacattcttaaaagttgaacttcttctgagaaggcaacctatagaatgaagaaatatgaactaaaaactaacaacgacccacctttccaggcatgacaaggagcaatgggtcccttcacatgggagcagagagctgccctgatcattcattctttctcaatactgtttcagaaactcaagtgtaagtactcttactttacaagttgccttttaattttttctgggaaaacattttccaggtggcagatctcatgtcattacattcttgctttacttaggaaatgagaaaactactgggaaaagcagctaagaaaaacatcctcacacaaatcatagcagctattgggcgattagcctggcgtaagtgaccttgtaaattctaccaaatcttgtcagagttatttctctattataactaagataaatagaacaaatcagaaattactatgaatcaacactcatacctcacttgtagctcttcctcaaattaacctactttctaccagttttttctataatcacatatttatttattagctggatattcatctagcaatatcattgtatgtgtacaactcagtggatctttcttctgtgttctactcaaaggtgtatgtttaacactagatatggtgaacaatagcctaatattaactcctaataaagtatggagactttattaataaataagaaatgattagccattcaataagttccaactatgaacaaatatatgggaaaaagaaaacttcaataaaatgtgtagtatatataaattaagatttttcttttcaccagtaatatctctagaatccgaagacagagaggagtttcttatccggtgtctataaatgagctttagattggtgaacattataagactgcacgcaaactggggtatatgggcatctttcttgctgagaaggcacacagctgcttttattagattctcaaagaggtgttggatcaagcacagatataaaccacaataagcaaatgactggcaaataacgattgtcttgtgttagttaagataaatgaaaatcaggttgcctctttcttctttcaactaagggggaaaagtcacttatttcccctaaggaatgaagatatttgcaccaaaaaacatctttggatatcctgtggcagacagccaaagtatttcaaaagcaatatgcttcacaaattgaatactcaagaagatccaattttttgcccagagaaacatggctcaatttcaagttcactaaagacagttgtcctattgatatgcaagtggcacagaatcactgaattaaaaaactgtgactgtttctccttcatttagtcttagactctcaaaaataaatgtattacgtgacctgacattacatgaaatatagagaagtatctaccttcacaatatgaatggcatttcttttcataaacatgactttgcacaaaagtttgtgaatagaggggggaaaatgaagtagcaatatggagtctatgaaagaccagctatttatggaaatacattgctatttggtcatctaactcttgaagtattagcctgcttctggtttgtttgtttgtttgtttgtttttctcagactatctcttggaacagaaagacaaaagcaactggttaattagtagaaattcatgggcttccctggtggctgagatggtaaagaatctgcctgcaatgcagaagacctgggttcgatctctgggttgggaagataccctggaggagagcatggcaacccactctagcatccttgcaaggagaattccacgaacagaggagcctggcgggctacttgcatggagtcttgaagaatgggatacaaccaagggactaacactttcactgtcatgaactgaataccacaaatcaacataaactgtggaagacacatttcttaacaacaatcttggtactgtcaacaatgtattgaccacagaggtagtcacacatcttttgttatccgaacatcactcaccacaaatgtttcaaatatccacttacatcaggcattagtctctgcaaaaatcacccgatcatttatgtgttaatattaaatggaccacataggaaattgatctgggtaccagcatcagaaactgcaggtgtttgttttgtctagacctaatacttacagaaagctagaagtgctttttatttttctctccacactccacccaagaaactcagcctgagtctttcctggcttccacagaaaacttcagtgcatgccaaaaaactcaaagcctccagaccttccctgtccttgggaatcagcttgataagggagagtacaattggcaggtccttttctaggcctcacctacagcaaagggaaggtgctacaaagagcaaacagatgactccacactggaaaaaaagccttgtaaactgtcctgcttctatacaaacattgggggtgatttacagattgctcaggtaggcatgcttctgcataaataaacgccactttatttctcacctaaggacactgcgtagcagacaaactcagaatttttaaaaggattcagggtcttaaaatatggtaacttatcccaattaagtggttgtaaaacaaatggaaaatcagtaaagaaagccaaccaacaaacctcatgaagactgaggaactcctaccagtgtggaaaaatcagaaatatcactatttcaaaacagaagttttactccaatcaagatgaactgatattccatttcctgcaaaattataaaatgtattcattcttgatgcatgaaaagcaggaggaatataaaaaaaatattgattggaaatatatatatagagagataaatagactagttatttgaattctgagaacatgcttaaagattatttctaagtctgtggtcaatattcaaccaaacagaaagtccagctccccatggcgcaagttggcagtcagtgtatcacagtgccatgggagagtcgaagaggaatgaatgggtgtgtgtgtgtgtacatgtgtgtgtgtttgtaaagggatgagaggacagataaacaaaaaaggagagaagagctattaatagaaaaccctgtcttttctgcagtagatatatagctaacaaagaatcctctctcacgtctcccaagagtctttgctaggtatccttacgctcccagaaagagaaaactgactctattttgtcctgaaaatctgagttttccccaaatgtctcagctttatctataaagcaatacgcctttattttaaaatgcatgtcagtctgaaggatctaattgtcaggagtttggctaaagaagagaataagaaaacattttttaagttgtctttttaccctccctggtcaggaagcaacagttagaactggacatggaacaacagactggttccaaataggaaaaggagtacgtcaaggctatatattgtcaccctgcttatttaatttctatgcagagtacatcatgagaaatgctaggctggaagaagcacaagctggaatcaagattgccgggagaaatatcaataacctcagatatgcagataacaccacccttatggcagaaagtgaagaggaactaaaaagcctcttgatgaaagtgaaagaggagactgacaaagttggcttaaagctcaacattcagaaaacgaagatcatggcatctggtcccatcacttcatgggaaatagatggggaaacagtggaaacagtgtcagactttattttttggggctccaaaatcactgcagatggtgactgcagccatgaaattaaaagacacttactccttggaaggaaagttatgaccaaactagatagtatattcaaaagcagagatattactttgccaacaaaggtccatctagtcaaggctatggtttttccagtggttatgatggatgtgagagttggactgtgaagaaagctgagcgccaaagaattgatgcttttgaactgtgatgttggagaagactcctgcgagtccctttgaatgcaaggagatccaaccggtccatcctaaaggaggccagtcctgggtgttcattggaaggactgatgctgaagctgaaactccaatactttggccacctcatgcaaagagttgactcattggaaaagaccctgatgctgggagggactggggcaggagaagaaggggacaacagaggatgagatggctggatggcatcaccgacttgatgcacatgagtttgactgaactccgggagttggtgatggacagggagggctggcatgctgtggttcatggggtcgcaaagagtcggacacgactgagcaactgaactgaactgaactgaactccttttgttaagtacttttttaaaatctcaaaagaaaaccccccactactactaaaaacctcaaccaaccaagcaacaagcctactggtatggcacagaagctaacacacaatgtttgttaattatttcgagtcttgggagtgtttaattacttttctacattgaaggaatctgcctgaagtctccataatcacaagtacattcaatgagagttacagcatattattacttctatgcaaaaaaagtcttttcaaaaggatcatacaggtaaaaataaaatttgatcttgaacaagccacaaaacagccaaacgttactctactaatatgagaaaacaacatggttatttgaattcacactgatttctcttgctgtctctggatctcccctttctggatcttctcctttctgtccttgtttccctgcacatgcatttttttcctgacatctcattctgttctgcagttccttctccagctcttttcttttcttccctggttgctaaacattttgcctttcactgccttcataatgaatgagcctgccattgaaagcaagtgtctgaaaccaagagcataaaagcctcagtaaagccaagaaccttatttactataactggcattctcatctcaacaacaattcagttcctaggagcaatttttagaactggtagcattataggcagagtttatatttctaatagcatcttgtatctaatttacaaagcctggatttcccaagtatattatggaacataattcttaactctgaatcagtcctaaatactcacatttttctgagaaataaaagattatccatttttggaatagtatactgactatactatctgctgctgaaaatatgcatattgacccaaataatgaccaagtatggtctttcaaatttttgcagccacatggcaaattcaatgatctaaaatatgcttggtataaagactacagtatatagtaccttatccatctcgtagttcagagcttccatcacacacccacaccaacagacacacaattttccaagaggaaagattcactcatactccatgatttatactaatttatcatgattaacttttacaaagaaggcttattagcacctcacagtaaatgctgatttagacactgagcactcatctgcatgggggaaactgaagcacagagctggagatggttcaccatccttagtttgagaaagatgtgcattgtctgagcagtgcagggaaagctttagaaagaagtctaaaagtggatgacgctgcccaggagaaccgccaggcactgaaacactgcctcctccatcgccactgactggaaaaaacaccattcatgctagaactcggccagcacacagtgcctagcggggaccaacaaggactcgacttttcagcacaaaacgtaacatctagacgctttgtgtcgattctgttttagcttacaatagagtcctgacaactagtaagctgcactttatgttgctgttctgtatcatagtgatgatattaaaatatggaacgttaacctataagggccaaagaaaactatgccagtaactactaacattgccaaaggaaatgtgaggtcaagtgctgctgtctaaaaagttcctatttgtaatggtatttgacacttgctagaaccataattttacacctacagctaagcactgtaggtaagaaaaataatgatcagaatgattctatgtgcccttaaggcaaatagattccccaaaaaattgtcttgattttcctgcaaaatgagataaaaagagaaaagtcaaagataattgaatttttaaattgaggtttctagaacatgaatatgaaattattgattcctaagcatgataaaagtcactgcatatagaatacattttaaaagcagaaaatttgatagataaatttggtccactgaaatttactgttcacacaaaaggtagtaaaaataaaaggctatcagttggaattcgagcataaaagctttaatgtcagagtgccatcgtttcctccctttttgatagacctacaaaagccaagtttattaattctttttcctttttaaaatcattcttgattttgggtgataaatcacaaagacatttctgacttgggatcatttctggaaaacataaatatcatatctataaggtagctgtctactacaaaaggatgcaaaaatgtatgctcagttgctcagtcgtgtctgactctggccctgcggactgcagccctccaggctcctctgttcatgggattctccgggcaagcatactggagtgggtttccatttccttctccaggggatcttcctgacccagggatccaactagtgtctcctgcattggcaggcagattctttaccactagcatcacctgggaatcccgcatggaaaagtagtcttttctaagaggaaaaaaatgagtcttcaatttccattaggtaaaatagaaatggaaaggtccacgattctagaggccatatgatccatagctctgaccagttcttgaccagaactgtaagtatggtttatatttttagattgctaccaatctgaaatatctattaatttaactgtaaaagtaattgatttgctctttaattaatgacttgagtacttccatcattggttatcagaaactgagtgagtaggcataaatgtaattcttgcttaactgaagaaaaaaggagcaattctcaaaagaatgaatctgaactagacagctggcagacaggactaaaccagacggcatattaaaaagaaagatagaaagaaaaaggaaacagcatatctaccctctaaaccctttctcattcaagaaactaaatacaattacacttcctgaacacagtcttatgcttgagaatctgagctaaaacagggtactattgttccctgtgctatgtgctgtgctcagtcactctctgcgaccccatggactgtaggcccccaggcttctctgtccacgggttttccaggcagagtactggagtgggttgccactttcctctccaggggatttcttcccgacccagggatagaaaccgcaccttctgcattggcaggtagattgcttacctctatgttattgttcccttcatgcccttattgctaaggaacgggacatgaacatgagtgtgcgtcaaaagaagtgaatttgtaccaaatttgtagttttgtaccaaagaaactgtgagagttggattttgctaaatggaaccctcatttatggggctagaaattgaatacgggttttaatgttctgatcaatgatttctttttttggccatgccccacaccacgtggcatccttgttcccggaccatggatctaacccaagttccctgcactggaatctcagtcttaaccactggatgaccagggaagtcccctttgatgaactacttttaaaagtctatgctctacaagtatttctccagtgtcaccatactagttgataacaggtgaactaaactttctttctgtagatgaacaatttataggaatataaaacaaaactaagtcctaattagttttttagtcctagttagtttcctaacacactgaaaccatactcacagaaaactagtcaatctaatcacactaggaccacagccttgtctaactcaatgaaactaagccatgccagtggggcaacccaggatgggtgggtcatggtggagagatctggcagaatgtggtccactggagaagggaatggcaaaccacttcagtattcttgccttgagaaccccgtgaacagtatgaaaaggcaaaatgataggatactgaaagagaaactccccaggtcagtaggtacccaatatgctactggagatcagtggagaaataactccagaaagaatgaagggatggagccaaagcaaaaagaatacccaactgtggatgtgactggtgatagaagcaaggtccgatgctgtaaagaacaatattgcataggaacctggaatgtcaggtccatgaatcaaggcaaattggaagtggtcaaacaagagatggcgagagtaaacatcgacattctaggaatcagcgaactgaaatggactggaatgggtgaatttaactcagatgaccattatatctactactgcgggcaggaatccctcagaagaaatggagtggccatcatggtcaacaaaagagtctgaaatgcagtacttggatgcaatctcaaaaacgacagaacgatctctgttcgtgtccaaggcaaaccattcaatatcacagtaatccaagtctatgccccaaccagtaatgctgaagaagctgaagttgaacaggtctatgaagacctacaagaccttttagaactaacacccaaaaaagatgtccttttcattataggggactggaatgcaaaagtaggaagtcaagaaacacctggagtaacaggcaaatttggccttggaatacggaatgaagcagggcaaagactgatagagttttgccaagaaaatgcactggtcataacaaacaccctcttccaacaacacaagagaagactctacacatggacatcaccagatggtcaacaccgaaatcagattgattatattctttgcagccaaagatggagaagctctatacagtcagcaaaaacaagaccaggagctgactgtggctcagaccatgaactccttattgccaaattcagacttaaattgaagaaagtagggaaaaccactagaccattcaggtatgacctaaatcaaatcccttatgattatacagtggaagtgagaaatagatttaagggcctagatctgatagagagtgcctgatgaactatggaatgaggttcgtgatattgtacaggagacaggaatcaagaccatccccatagaaaagaaatgcaaaaaagcaaaatggctgtctggggagcccttacaaatagctgtgaaaagaagagaagcaaaaagcaaaggagaaaaggaaagatataagcatctgaatgcagagttccaaagaatagcaaggagagataagaaagccttcctcagtgatcaatacaaagaaatagaggaaaacaacagaatgggaaagactagggatctcttcaagaaaatcagggataccaaaggaacatttcattcaaagatgagctcgataaaggacagaaatggtatggacctaacagaagcagaagatattaagaagagatggcaagaatacacagaagaactgtacacaaaagatcttcacgacccagataatcacgatggtgtgatcactgacctagagccagacatcctggaatgtgaagtcaagtgggccttagaaagcatcactatgaacaaagctagtggaggtgatggaattccagttgagctattccaaatcctgaaagatgatgctatgaaagtgctgcactcaatatgccagcaaatttggaaaactcagcagtggccatgggactggaaaaggtcagttttcattccaatcccaaagaaaggcaatgccaaagaatgctcaaaccaccgcacaattgcactcatctcacacactagtaaagtaatgttcaaaattctccaagccaggcttcagcaatatgtgaaccatgaacttcctgatgttcaagctggttttagaaaaggcagaggaaccagagatcaaattgccaacatccgctggatcatggaaaaagcaagagagtgccagaaaaacatctatttctgctttattgactatgccaaagcctttgacggtgtgcatcacaataaactgtggaaaattctgaaagagatgggaataccagaccacctgatctgcctcttgagaaatttgtatgcaggtcaggaagcaacagttagaactggacatggaacaacagactggttccaaataggaaaaggagttcgtcaaggctgtatattgtcaccctgtttatttaccttatatgcagagtacatcatgagaaacgctggactggaagaagcacaagctggaatcaagattgccaggagaaatatcaataacctcacatatgcagatgataccacccttatggcagaaagtgaagaggaactcaaaagcttcttgatgaaagtgagagtggagagtgaaaaagttggcttaaagctcaacattcagaaaacgaagatcatggcatccggtcccaccacttcatgggaaatagatggggaaacagtggaaacagtgtcagactttattttttggggctccaaaatcactgcagatggtgactgcagccatgaaatcaaaagacacttactccttggaaggaaagttatgaccaacctagatagcatattcaaaagcagagacattactttgccaacaaaggttcgtctagtcaaggctacggtttttcctgtggtcatgtatggatgtgagagttggactgtgaagaaagctgagcaccaaagaattgatgcttttgaactgtggtgttggagaagactcttgagagtcccttggactgcaaggagatccaaccagtccattctgaaggagatcagccctgggatatctttggaaggaatgatgctaacgctggaactccagtactttggccacctcatgcgaagagttgactcattggaaaagactctgatgctgggagggattgggggcaggaggagaaggggatgacggaggatgagatggctggatagcatcactgactcgatggatgtgagtctgagtgaactctgggagttgatgatggacagggaggcctggcgtgccgtgatcatggggtcgcagagtcggacatgactgagcgactgatctgatctgatctgaagtcctaatttcttttttatactctctaggctggtttcctctagggagaggaaggtttagtatggaccaaattcataccatcaaacctgatgtgtggaattactggacagttgaagtgttttggcaaggtagaagtaatttttgccaacgttagcgaggatgctgcggaggacacacggaagaaatcccaaagggtcagagtgctggctcgcctcattcgtctcatcttaggagaaattataattgctagtggtaacaaattcgcctgtcagtgcaagagacacagatccgatccctgagtcgggaaattcccctggagaagaaaacagcaacccactccagtattcttgcctaggaaatcccatggacaaagcagcccagaggatgacagtgcatgggatcacaaaagagtcagacacgacttagtgactcaacaccaacaacaaagtgaataagctctaaagaaaaaagaaaaagaaaaaagcttcacattcgccaatgtgattataacaaagaaaacagacaggagatactcaagaggctaaaatcttaaatctgcctctgagctgtctcaatcaaattatacatcttttttctttttttgcaaaagaaggaaagagtggctttatttctttgccaggcaaagggctacagcctcaggaattgttcccttcaaattataaatcttttgatcttcagtgtacctgtttctgttttgatcttaccaggctggagaggaatactagaaataacaactgtcagaaacataatatggtcactaagtcctccaaacttttgttttaaataataaaacaatgtagctacatactgacttgtgattttttttttactctccacactgacttaaatttaaagtaataatggaaaactaaaagttacaacagaaagaaatatttaaaaacaagcatattcgggtttccctggtggctcaaatggtaaagaatgtgcctgcagtgtgggagacccaggttcgatccctgggttggaaagatcccttggagaaggaaatggtgactcatagcagtattcttgcctggagaagtccatggatagaggaggctggtgggctacagtccatggggtcacaaagagtcagtcacaactagtgataaacacacatatttggaaaaagggccagtagaataaaggtctaaaaactctcttgctactgaagtcagcattagtcaactaaacagtgagactgactcacatcacatctgcagggtgttctctttagcaatgacaacagtacaacagcaaaaataatctgtaagttatctaggcattatcaaatccaccgaccagaggccatcttctgacatgtgaaccttgctttgggccaaacttttagagaaaggaaatttaagagtaaggcataaatctggagtactgcctgggtcagaagacacctgaatacttaagtttatattccaagagactatgaaaaaggattgctggtaatagtgacaagtaataatgagaggtaatgtcagtgtttctatttattctagagaaggagaactgacagctgtaattccaatacttatatgacacataatcatatatggacacatacagaaaatatatagagtgcacatacacacatatacaaacatattcagtgtaagcatgaaagcaatattttaaaaaaactcacaaaggtaaattggctcaaataatacttcccctaagatcatcttcctggaattgtataattgtgaaaacctcattacttattactctgaaaaacagtacaaatacctcaaactcaaatgtctagacaagctggcctagaatcaaaattttaaagtcaactaaaaatctcaaatatgctttcaaatttgtttttgtatttctaataatgaagaacagaataatgaagaaaagtacttaaacctttcctaagtatcagaagctaaactggccagaagcaagtataaaggattttaggttggaaacagaaaatacttgaggggggggaaaaaaagtgtaaaatccaactttttaaaagaacataactgattaaaaactttaatatctacttaaatctaaagtatgtgattgctgttaataggaaataagctgcttgtatttcaagatattttactacaggataataatcactcttaattataaagctgtcacgttaaaccaaaagcaccaaatcagaaaaaggctgtgatttcaccaccggtacctcccctgggagctttggaattttcctgttacactgagaaaatttaacaaaaccatgcaccacttccaccacagagacaaaggtaattactccactaatccataatattttaaagtgtgaggtcacaaaacaaggatctatttatattcaaggacaatcctgaaggtaagaattggcgaaaaaaattcttagctttcaaagagaaaacagttccttttcaatcttcttcaaagaacataagaaagatgcagcttttggagcccagcttttggcaattcaacttgatggcgttctcaacagacagaaggatgaagatgtgcaaaaatgcattcatgtgaaagacagatgtcaagtcggggccacttactcagccctttatttaaagaggccagattcatttttattttttaaaggacaaaaattcaactcagattgtttaatgttcatctataaatgtgacggctttttatgaaggctgacaaaccagcagaataaattttcctgcctggaggtcaaatatcaactaaccaacttggccacgtagaaaaaataacaaagtaagacatacatgtgggcacacacagaataggtaccttcagctgattgttgaaaatatcaatctcctgtaattttgacctagtttctttctccacttcatccagttggtctcgtagctgctgccgagccagttctttcgcttctaaggctcttttgagtgtgagaagtgaatcccctgttttagaaaaacatggtgagataagaaaaacaaactggcagtgaggaaaaacggcttttcaggttctcatttcttgcctgtgaggaaggaaaatgtcaactttaaaaagaaaacacctactgtgcaaactgttttgctgaacttgtttcaattggtcattgagtatctgtttttctggaataagtcttccaagcatttgctgggactcctaggagagaaagagaatgcagcaatgaatggtggagaaaactaccatgtttagatccaaagtcctggcaggcagaggtcaattttctgctccttcaaagattctcctaacctcatcccaaatcgactacagcgaaactgcatttaatcactagtcagggttgttgttttcttgccaagaaattaactgtttgccaaatgcttttcactgaaataaagtttaaataagacagttatagctcccttgatatttcttacatttttattgacttactgcctatttataagcttttaaaagtgaaccacaagtacaactcagcagagaaaagggaaaggaatgatctctcaaattgcactaggatcaaatacaaatgcagttaccctgatatttgtaaactgactcagtagtttaaccaggaactgttctgtcaggaactttgatccttaatagggctgaactgagggtgaccacacacctgaagtcggaaacagaattcaaaccaggactttaataattagaatcttagccgccatatgtggctccaccatatggagctgaggataaagccacagttttaaacagctgcacagaaatcttgaatcgactattttttaaccgacatagataaaagctaaaccatattgtacaggactgtgaggcattttcatgggtgacttgagaatcaattgtatttgcctaagttcagcttaaattattcaatgtagtttctacatatataaggaaaaaagacagcttttatagcctttattaaggaatatttgactttgggggcttcccgagtggctcagtggtaaagaatttgcctgcaatgcaaacccaggttcgatctctaggttgggaagatcccctggaggagggtatggcagctactcaagtattcttgcctggagaatcccatggacagaggagtctggagggcaacagtccatgaggtcgcgaagagtcagatatgactgaagtgacttagcatgcatgcacgcatgtatttgactttcatttttactctgacttaagaaaaataaatctctatgtattaacttttcatttgaaaagtaaaaatgtcttcatgaaaaattttcacctgaggctaaaaaccagtcctttctggaacaaccacctttagataccgactggcttgtatgtaagaaatctttgtgtactatacatcccaaccgtagggcgatatagctcagtggagaacatttggaagcatcttctcacatgaataattcacacaaacaaaagtactctccccaatcccatcaaatttagacagaacagaatacacaaatcagaacattttcccaaaaaagcatagccaactgggctcctcctcttattcgccccactaaaccaaggccacgtctctgaccaatccccaattttctttcctgaaccagggcaaacaaggaagtatcaagatgaagcccggctcgaaatcactgagacacgaaatcttaaccagtggaccaccggggaagtcccaacattacttctaaatgtacaatctaactttctaaaaataggtcaaatcagtatgaaggggtacttgaatcatttgcatagcaagaatctgctaatacttataaagaaagaaaaccaatatatcattgcctactatgtacctgactttcttcaaaccatgcattatttttaacttcactgctttttcaggaaccttgatttgtattttattttcaataactaaacacactaagcatcaatcataaacatatgtatggatacacagcattcagagataataaataaacctatggtttttggtcctaaattttctaagggcatattttatgaaacttctcattaatagttagtgaaagacacagagagttaacatagaaaagatcgtatttgtgcatgcattttaaaatattttcaaataatttctagcagtgaacttctgatactatttacattatatgtcatatgctaatatttcaaatatcaaattaattaggatttctgtgataatgaggaaggacactgaagatatgaacaacactaagaaccaacttgatcaacttacatttgggggacaccctactcagcttcaacagagtacatggaacattcaccaagacagatcacatgctgagccataacataagtctcaataaacttaaaaggattaaaatcacacagactgtgctcacagattataccataaataaaccagaaatcaatcagacagctcagaaaaaagaaatccaagtatttggaaactaaactgcataattctaaataacccttcaaagaaatgacaaaggaaatcaaaaacaggttctgaatggaatgaatataaaaatacaacatgttaaaatttgtgtaatatggctatgatgatgcttggaaggtaatttacagcttaacatgtttatatattatcagaaatcaagaaagttccaaattcaataatctaagctattcttaataggctagatagaagcaaattaaacccaaaataagtaaacggaaggaaataataaggagccaaagtaaatgaaatagaaaacagagataccatagagaaaaaaacaataaaataaaactatttatttaaaaaacatcaataaagccaattagttcccagctagactgttggagaaaagagggaggtggaagagaagggagagaacaaagaggagaggaggagtagaaatgggaggtaaatgacacaaattttcaacatcaggatgtaacatcactacagacgctacagacttgcaaagaataagagaatatagtaaacaattttatacaaataaatttgttaacttagatgaaacagacacattcactgaaagatacaaattatcaaaagagaatacagcacaaatagaaaactggaatagccctgtatctactaaacaaattttgcaattataaatcctaccacaatgaaatgtccaggtcataaggcttcactagtgaatgccaccaaaaatttaagcaagaaacagtaatccctcagtatccatgaagtactggtttcaggatctccacaataaaaaaacccaaggacgttcaagttccttacatagaatagctaagtatgactggcactctgaatcctagggttggttgaatctgcacaggtggaccaactgcactgagactggagtctgataactatgaaaggtggcaagacaaagtttttaagaaatatatagggttttaatcttccctggtgggtcagatggtaaagaatctgcctgcaatgcaggagactcgggtccaatccctgggtcaggaagatcccctggagaagggaatggctacccactccattattcttgcccagagaatcccatggacagaggagcacgataggctacagtccatagggtcgcaaagagtcggatgcaactgaaaaactaacactttcatactttcatacaggattttaagagagaagctgaaagggttagctaaggaggcagggtggtgtcaagttaagaaggaaagttttgaagtaacataaactgggttaaatttggattcttgttgcccagctagaaactgattctgaaacagaatattcccttctagaatcttcactttcccacttatgagagtgatgatactgcccttactagggtattgtggaattctatttaatattcacattaaggtcttcacatgccaggccttcaataaacagtagctaccaccacagacagtctaacatccagtccatctggattcagcaagtctaagatcaaatttccattcaaatatgcagacacaaagggactatcatactatccgttttacataaagaacttgagcatccatggattttggtatcctcagttagcttggaaccagggcaccatggatatcaagggaggactaccatttcatataattcttagaaaataaaaaagaatataccttatttacttccttattaccctgataccaaaggtagatgaggacattatgagaaatgaaactaatatcccctatgaatttaaataaaaaaactcataataataataagttgatctaaacaataatttttaaaacaataatataccatgactaagggcagtttcattgagttagacaggctgtggtccatgtgattagattgattagttttctgtgattgtggttttcagtctgtgtgccctctgatggagaaggataagaggcttatggaagtttcctaatgggagagactgactgagggggaaactttatttttgggggctccaaaatcactgtggatggtgacttgagccatgaatttaaaagacacttactccttggaagaaaagttatgaccaacctagacagcatactgaaaaaaaagagccattactttgtcaacaaaggtccgtctagtcaaggctatggtttttccagtagtcacgtatagatgtgagagttggactataaagaaagctgagtgcagaagaattgatgcttttgaactgtggtgttggagaagactcttgagaggaccttgaactgcaaggagacataaccagttaatcctaaaggaaattagtcctgagtgttcattggaaggactgatgttgaagctgaaactccaatactttggccacctgatgcaaagaactgactcattggaaaagaccctgatgctgggaaagattgaaggcgggagaagaaggggacaacagaggacgagatggttggatggcatcaccaactcaatggacgtgaatttgagtaaactctgggagttggtgatggacagggagacctggtgtgctgcagtccatggggtcgcaaagagtcagacacgactgagcaactaaactgactgaactgaagggcagtttaccccaagaatggaaagttggtttaacattcaaattttaatcaatgtaaagcaccatattaataaaataaaggaggaaaaaacactttaaaatctccacagttgcaggtcaacagagggaaatagtggtaaaaggacagatgtagatcagcggaacaaaagagagtctaggaaagatttttacaaatgtggtcagctgactatcaacaaactactaaggtttttaataaacattgatagaacaaagtgggtgttggtatggaaaaaagtgactctcattaccttaccttgcacttaacataaaaatcaatcaaaactggatcacagaactaagtatgttagataaaagtataaaacttctggaagaaaacataagggaaaaacatcttcaatcttgggatagtcaaagctttcttggatagaacataaaaaactgtaaaagaaaaaataaattgaactttaaaagttaaaacacctgccctttaagaaacaccattacaaaaatgaaaaggcaagccagagactaggtgaaaatatttgcaaaacacttatctgacaaaggacttcttataagactatataaagaactctgataataagataagcaacccaataaaggatgagttaaagatttgttcacaaaacacatacagaagatgcacactaatacacataagaaccaacagccaacagcattcagccttcagggagatgcagattaaagttacatgagacattgttgcccacccaccagagacactaaaaacaatgacaaaagggagtgttggcgacagtgaggagcagctgaagggctggtgcaccgctggtgagaatgtgaaatgacacaaccactgtagaaacagtttgatagactctgacatggctaagcacatacttatatgacagtaattcccctcctaaaatttaaccaagagaaataaaatatatttccacataaagaaatataagtaaatactcactgcagctttagttataaagtccaaaactggaaaaaacctaaatgtccctcagcaggtgatgggataaataaggaaatactactcagtgatgaaaaggaagaaaagctatgaccaacctagacagcatattaaaaaggagagagacattactttgccaacaaagtaatgccaaattttccacctagtcaaagctctgctttttccagtagtcatgtatgaatgtgagagatggactataaagaaagctgaatgccaaagaattgatgcttttgaactgtggtgttggagaagacttttgagggtcccttggactgcaagatcaaaccagtcaatcctaaaggaaatcagtcgtgaatagtcattggaaggactgaggttgaagctgaagttcaatactttggccacctgatgcgaagaattgactcactggtaaaggaggagatggggacgacagcgtgagatagttggatggtgtcactgacttgatggacatgagtctgagcaagctctgggaattggtgatggatagggatggggtcacaaaaagagttggacaaaattgagtgactgaactgatgaaatggaacaaaggactgattcactcaaaaatatggataaatctcaaaactgtcaggctgagaaaaagaagctgaaattaaagtcacggtgtccaaaactgatcaccttttaggatggtatgcagaacagtatctacatgaattggataccccctctaactcaacacttgaaaccaaaccagatgaaattttaacaacttggtggtgaaagctgaataggtaataaaataaaagcagaactgcttagagtactccattgtgtctccaactattctctatacacgtatctctggaactcctcctgatatacttaattgcacttctttattgtggttatcatggtaaagccaaagtcccaggagtagactacaggtcctgcatgatccagcccccagctgctccaaccatagctgtctccttgctgtaactggcatcccagagaccagcttatagccttagttcttctgcacaactgttgccctacctagaacttgctctgctagatgtccatctggctcagccattcacctctttcaagtctttgccccaacatcatactcacagagatgcctgacctgaccacattacttaaaatcacaggcctctctactggagactctcttccctactcactctccagagcaactttccctcttctaatagagaacatgctagtcttatttcctgagtccttgtctaccctgcagacagaaggtaagctccatgagggcagggtttgtctctgctatccactgctggatcctcagtgcttaccggtgcttgcactgagttggcatgcagcagtcccagcaagtgtgctgaattaccagacagcctactttcagaggatgagctgattggacggcatcaccaactcaatggacatgagtctgagcaaattctgggagatagtgaaggacagcgaagcctgggtgctgcagtccatggggtcacagagtcagacacgacttagcaactgagcaacaagtactttcaggcaagtaccctgtctgcttcatcttggcctgctggatgcttgtgcgtgaataagtgaatgaagtgaatcaaagaaaggaagccaaaaggcttttaagggacatattttctcacctgtaattgctgttgtaggtgggtgatttctgcaattctcaactctctagatttgtttgtgctctcaatttcttgcctttgggttgtcagtcgacatctgatatcctgaagttttccttctaattgatgttttttatcattctttaacaagtgaaaaataataagaatcattagcatttaacaattcaatgcaagtgggttcccaaagcacaatcaaactactcactagagcttctaattcaaattccaaagtctttttctttgctttcagtacaactatgtcttcttgttctttgtttctttgatttaatagttcttgtcttcgattccgttcccattcaagctgtctttgcctttcaagctcccgtttcgcagcctgtgacatacacaaacagacgatttattaactgctcagttcttacactcttcaatgtctcttaataaacgttacatctcgtaagtcttttcttttagggatgaaatggtattaaacacgacaagtgattttcattataaaacagcacaacatttcatacaaatatgttattacttctatgggaaaaaagagaatattcagaaaggcaatcacagtcacatgggttgagaacagaaaggactattggatcactgacattcgattccttaggtctttaaggatgcttggtgtagtaagtaaacctgctcttccttatttactgactcataaaagaaaacaaggaaaattatgggagttccttggtggctagggctccgagatcccaatgcagcatgcccgggtccaatccctggtcaaggaactagacaccacatgcttcaactaaagggcccacatgctgcaactaagacctgctgctgctgctgctgctaagtcgcttcagtcgtgtccgactctgtgcgaccccacagacggcagcccaccaggctcccccgtccctgggattctccaggcaagaacattggagtgggttgccatttccttctccaatgcatgaaagtgaaaagtgaaagtgaagtcgctcagcctaaagcagacaaataaatacaacaaaattatcttttcaaaaaaggcaagttaacctaggaaaacccccagaactaacacacaaaacaaaaaaaactttcttccatcaaacgagtaattattatttcttctgtcataggagaaattatttatctcaagctttaaaagtccatgactcctatgtccctaatcatttgtttccttgttagcacagaaggctctgtaatttttccagcaacgtcagctctcttcaaccctgactctgatggctgctgggcagaggaagtgtcagggcacctggcactcttcattgtatcataactgcttcttacacatttgtgctccagctacactgtaagggcctggaggacaggtgggtacctagtcaccacaacatctccaggaacttaaccaatgcctggcacatcgtaaatgccattatatagttctgaacaaacactctgaaatgctttaaaaaaaaaaattaaagaaggaaaggtggcctatcttttggttgtcattctggaaaggaaaatcttgctattatctgtgtgtatgtgcctaaatgaaaaggcaccttagaagctagaagttttcaaaagcattcatcaggagatgaaaccatattatttttttataaagaaaaaaatccctcatctttaaaatacatttcatccacacaagaggatcatggcattgcttctgtcacaacatactaaaactggaaagacagacaagagattggcttggcccacatccaggtatggcaccaaatttaggaagccttccataaaatacagtaaagattactagacttgttttctaaagtggaaaaagaaaaaggtgacaaacactttaattatttagtgtggtaccattacagtggtttaaaaaacaatttcagtaaacgctcagcctctctaccatatgaacctttctatttctatatgtgtatatgaatgcagaaaaaaggctaaaaaatacataattgatagcaatagtttgtcataagactcagttatcaaaaacttgtatatgaatgttcacagcaatgttattcaaaatacccaaaaggcaggaaaaaaaaaaacaaaaaccaaatgtccatcaaattgatgagtagataaataaaatgttgtctatccaggtaatggaatattactcagttataaaaaggaataggtatttattcaatctacacactggatgaaccttgaaagtgaaagccagacacaaaaagccacatattctatcattccgtttatccaaaatgtccagaataggcaaaggtgtagagacagaaagtaaatctgtggttgttcagggcaaggcgcaatgggaaaggggaatagtaactccttaatggttaacgaatttcttttcagggtgataaatcagtggtgatggtcacacaactttgtgaataactaaaactactgaattgtaaaaagaaaaaaacaagactgggttaatgtattattgttgtgtgtgctcagtcactcacttgtctctgactctttgtgacaccaaggagtacagcctgccaggctcctcagtccatgggattttccagacaagaatactggactgggtgccatttccttctccaggggattttcccattccagggatcaaacccacatctcctgcactggcaggcagattctttacgactgagccatcagggatggccatatttttatgccttcttaaaattttgtttcttcaaacttagatggtataaagaatctgcctgcaatgtgggagacctaggttcggatctttgggttaggaagatcccctggaggagggcatggcaacccactccagtattcttgcctggagaatcccatagacagaggagcctggcggggctacagtgcacggggttgcagagagttggacacgactgagcgactaagcacatggcatgtgcgaatctcagttccccagaccagggatcggacctgtgtctcctgccatctcctgcactgcaggtggattctttacctgctgagccatcagggaaggcctgatacactactgacactttaacgattctagaagagcgcccgtgttaatgacatgactgtttccagctgctcacctcccgcctctcgatttccttccttcgctcctcctccctctgccgctccagctcccgctgcttctctagctgcttttccagctccagttgtcttttgcgctcctgctcctggcgctcccgctccttcctctcctgctctgcccgctccagctgggccaggcgctcctgctctttacgctgctgctccaagagcgcttgtctccgcttctccagctccaggttgccccgttcaaagttctcccgcttcttatcttcaaaggttactttcagacaagagacaggacgattatgaaaagccatatgatgttcaacagacactttcaaaggaaaaactccacagcacatcgtcaatgagtaacggacctgcagatacgaactccctaagcttcccgcctgcctctgccctcacgaataagcacccaggtacaggcccttacactcagcgtctcgtttacataccctcccctgcagatgaaccgcatcacagcattcagaacgcccaaaactcagtttctggaataatctttcgacagaacttctccatcaccactcattctccataccttccctgttactttatcctttcctttttctacgaccttggttcagcaactgaccctctctctccgctataccacaaacttctccttttctacctctttttctttggccagcagtcgtgaggtatcttaattccccaaccagcaattgaaccctagctccctgcattgggagcccagagtcttaaccactggaccaccaggaaagtccttccctttctatctctttttcctttgcataaaactgtgccattctgttttcaattttaacaaatagaatggtttctggaaatagagctaagatgatacgtctcctcctgggtttcacactgaagagcaggttgtgccctaatcactatgcagaggacactcagtaaactagtttttccaacctattattcagtttccttctttgaagaacaccaaggtaatgaattttagacgatcctcaggtcaacaattttttttctctgatccttgctaacactgtttgcacccattttattttacttaaaaaaaaaaaaaaaaaattccatgctctatgtcccttctgtgttttcagcagtgtcaactcagctttgtgtttgcctcacatgcttctcctgggagccaaccccagacactggaagctctcgctcccagcctgtgcagcacgccattcccattgttcccaatctatttcaagaactgtcacttcacactttgtcttgagatatgtagctgtgagcatccttttggcttcttcccacgttcctgcctggcctccactgaagacactttccttaaacacggcagttagatgagagatcagagatggtaagcacgttttgttttcttgttctttttgctcctttgtagtttcagaagaggcaacacccatttcactcccccactttaaaactgcaagtcctctcagccagagaaaggaatgaagtaaatgatacatgcaaacctagacagcgtatcaaaaagcagagacatcacttcaccaacaaaggtccatatagtcaaagctatctttttccagtagtcatgtatggatgtgagaaaagtgaaagtggaaaccactcagtcatgtctggctctttgcaaccccatggactatacagtccatagaattctggaggccaggatactggagtgggtagccattcccttctccagggggtcttggaccacaaaaaaggctgaaaatcgaaaaactgatggttttgaactgtggtgttggagaagactcttgagagtcccttggactgcaaggatatcaaaccagtcaatcctaaagtaaatcagtcctgaatattcattggaaggactgatgctgaagctgaagctccaatactttggaaacctgatgcaaagagctgactcattagaaaagaccctgatgctgggaaagattgaaagtgggaggagaaagggacagcaaaggatgagatggttggatggtatcaccgactcgatggacatgagtttgagcaaactctgggagatggtgaaagacagggaagcctggcatgctgcagtccatggggttgcaaagagtaggacacaactgagcaactgaacaacattgtggataaaatctcaaaaatactacgctaagtgaaagaagccagacaaaagaacaccaactgcataatactatttctatgaaatattcagagggggtaaatccaaagacacagatagcaggctgatgattactagggactggggaaaagggagaatgttgagtaactagctatggccattgttttggactgagtgttttccaccctatcaattcagacgtggaagcagtgggctggtatttggagaggggacctttataattcaggttaagataaagtcatgactatgggaccttcgttatgaattagtggccttataagaaaagagagagtcatctttctcttttcatgtgctgctgctgctgctgctaagtcgcttcagtcgtgtccgactctgtgtgaccccatagacggcagcccaccagggttccccgtccctgggattctccaggcaagaacactggagtgggttgccatttccttctccaatgcatgaaagtgaaaagggaaagtgaagtcgctcagtcgtgtccgactctagcgaccccatggactgcagcccaccaggctcctccatccatgggattttccaggcaaaagtacacacccagaaaaggccaagtgaggatctggtgagaatgcagccatctgcaagtcaggaaaagcgcactcaccaggaacagaattggatggcatcctgatcatgcacttttctatcctccagaactgtaagaagtaaattgctgctgtttaaggcacccagactagctgactttgaatgatcaatattatgttaagcaaattttacctcaattaaaaaaaaaaacaaaaactgaaagtccctatatacctttttaattccaaaatctggccccatttctgatacacagaggcacataataaacagctgttgaaagaaagaacgcattaaccaaaacctctaataatgtcacatcttgttcaaaacttaaaatgttggacttccctggtggcacagtagacaggaatccacctgccaatgcaggggacatgggttcgatgtccaggaagtcttccaggaagactccacacaccgtgggacaactaagcctgagagctccagttactgaaaccagcttgtccagagcctttgctcagcaacagagagaagccactgcaatgagaagcccacacaccataattcagagttgatccagctcacctcaactatagaaggcccttgcatggcaatgaagacccagtgcagccaaaaaagaattaaatatcttccaccaacagaaaaagaaaattccaaattctaaggattcctgtccttatttgcttgaagactttattcccatgattattaacctgaaatgttcctctttcccagccctgtaatgaccctgttgatcttcaaatctcaactccactgtgacctcttccatagagatttaactgccagtgtatttgccagtctgtgctaaccaaccacaagtaagctctgctgtgtatctataattctgccttcatgaatttatcacagttatgcattgctttgatggtgtttatatggatgtcttaaatcctcagttgtatcctaaccttctagagggcatggaccatgtattattaacgttcagattcttcactctactcaacacacttccacaaagaacattttccggaagcagtttcagtgaacaaaaagtaatttagttgaagaggagggcgggagagctagtagtgtcctcagcaggtcgattattccctgagcacctgaaatgcagcaaaatgacactgacagggtatttaccattttctcttgactccataataaatttcatcagggtgtcttagtatcaattaccatctcatattaataattcataaccaccagagaatattttaatagtatgatgaatttctcattgtaaatgagggtaatttaaattaggttcctattaaatttaaaatagcttcttgctatcaaggagctttcgattctataacaacatgagaaaacaacagacggcaactttatattctatttctatactggtggtattaagccattaccttaaagacttatcaattttcagtgcttaatagataacatttataaaatttctggtaagtgttaaatagatttcaatttcagagctagaacaaaggtgcatcagtacattctatacatatattaaaatccaaaaagcatatgcaaagtgtctcctttctgactaaggtcaggtaaagaaacatagcaataatgtcattagctaaatacattttacctccatctttgccctagagacagaaaatctctaacaggctgtaaaattcaaatatgaagactgtcttaccaggtagtttcttttctagttgttgctgttcatcttccaaaactggttcctctggcaacctctgatccaccgaagttgaggttatgacagatataccactaccagatcgaactcttctgcaattgtggaaaaaagaaaatggtttcacgtctagctgccaagatagaattgagcaaaccatgaaaaaccaccttttaaagattatgccatagaaaatggagcagatgacatttttggtgaggaaaagataaagatgtgctcttctccatttatataaagagtttttaaaaaatgaatatctgaatgtcatcagactatgaatcccaagttcatttaagtatttagaaccatcacaaaattaggacaatttcaaaggattaaatcagttaacaatcatcaagtggttggagcagtgtctgagacatagtttccttcctatggaatattaaattcttccaagggaagactagcaactccgctaattgtgagcatctcctttccctttccagaatctctacatttgctctcttaataaacacatggaatgactacacttaatagtccttaaaacaaatcacatcgtttaccagctagtgtcactttccccattatctttctcttttaaaccagtctacctatcttctttctatgctttctttatgtcagcttccaccttgcagctcagatggcaaagagtctgcctgcgatgcaggagacccgggtttgatccctgggttgggaagatcccctggaggagggcatggcaatctacttcattcttcttgcctgcagaacctccatggacagagaagcctggagacagacacaactgagcaactaacacacacacacacatacacatacaaacatacccaccagtgttaagtgtctcttatgattcttgcagctgtgagattttatgaacaaactgtccagctactggtttcttcctacactgtgttctcagcttccccgtacttcatatgtgctgaccgcaatggttccatgtctcatacttttatggagactttgcccctaatctttcccgacattggaggaatcgggacagaaattcttatctgggcttcttttgttcttctgtgcacttgtaagagctcaaatttgtcttttgagttaaagctttgagaggcagttgtctgagagggctatgcgtacacggctgtgtgtgggtgggggataccagtcctcccaattggactctgaactaccctcttgacctctccactgagattgtaattcagaccaggataattttctttcattattttgctgattataatttctacattgccagcattttgttacctctggaatgtgtagaattcacaggcagaatctcggttatttattttctatgtgcaggctgatgtttcactttaacatttggtgagttttgattacatggatagtctcaaaagcaccaactttgtgatgttatacctgattgttttactaacagtctatttaagtactttaaagtacggaacaggcaaagattaacacaaaagctgcctaagaagattcagttcaatacgtggagatttcattcacttgccaagaagaaaaaatgaacataagatatacagccaacaaagccaagtttgaaatgaacatacttagcacacaatttcttatgagaaccaaatattccttacctaaaggaaggtggaatgtattctgggggcaggaccggtggcagtggttgaccagacatagctacatcaatgaggtgcatagccaggataaattcttctgctgtgagttttccatcttgatcaatgtcagaaagattcctattcaacagaaagttcattgtaatctagtttcatgaaaatgcatgctcgttactattcacaagtgatttcaatgatctgttttctcattctgactctatgccagttgagtccttctgtacctccatttataaaaatcgtaccgacttcataccactgttacaaagacaaaatgagacaacccatctagctgggatggtgctcagcattcaacagatgttaactgcgattataattacatgcttctcagtccttgcacccatttaagctatgtcatactcacattccatgtgtgtttaaacaccacgctccacagactatcaggtcagatactaaatgtttaagctttgcagaacacacaatcactatcacactgaattctgctgctccagcaggaaactagccacagacagtatacaaagaaatgaatgggcacagctgtctttacaacaaaacttcacctacaaaatcagctgcagacaacatttagctaactggaccaacccctgatccaggactccaagtgtgggtcttcacggcctccaaccagaggcaagatgttttctgttccttaacctcacgatttaatcaccactgttctttataatcttaatttaggattagctaattaaacagaccttccccagcaagtccaagaatatgactttttaaaaaaacaactggacaccaaaaagagaatgcaagacaacaaagctgttcactaagatgtcaacagaacagacgctacactgagcaactaactgggctttgctgatgccataaatcaagaaactcctccaaagtctgaaatttcctcaggtggcataaactttttttttttaaggtacaatttccgtaatatccaccccttttatacagtatggttctgtgagttttgacaaacacaatcagttgtatggctactacaatgaaacagaacagtttcatcactgcccaaatttccctgtctctttacagtcaccccttctttgcctccagatgctggtacacacatttcattatatgctagcgtcatgaaaacaaccaacctccataaatgtgaggtctttagcttttatttcagagggtcctaggatactggtacacatccagacttcaagaggtctggatgtgtcacagagataagatgtttgctaactggtctattattactctaatgcaaaaggtaggctctttaatacaaaacagaaagggccaggctgggcttgacctagagcttgaccacttatgaaacaaccaaatcaacgtgcctgcagcaaaattaggatcctagcaggtaagcagtgcagaccgggtttatcttcctggcagaatcaatgaataatgcataactgagaaagaaacactcctgaagaaaccattctagttaatatttaagtgtaaagaatcctacaggatttaggcaatgctcatcaatagctactaaaaatcattacagagaaccacctggtggtccagtggataggactctgcttttccattgcagagggtacaggtttgatccctggttagagaactaagctctcgtaagccacgcggcacagccggaaaaaaaacaaaaattaattacaaaatagagagacatttgtgtgcctcctgataaaagtactcagtatcatctctgatgcactttgcaaaaaaaaaaaaatcaaatttgaatctgacaagtggttctcctcagatctgaatcagtagttctcaaacactgattgatttggtacagcaaagaacatctgtcagtgtctggatttctgatggtcacatgtgggggacgggggggatcatactactggagtcggcagaggccagagacactacttaaccagcaaagagttatcatgccaaaaatgtcaacagcactgaggtggagaaactctaccttagatctaatttccaatctacaggaaatacaagaatgaattaacaccacaagggtgcaatcagctaaaggtgggctggaagaaagcataggacaaatgatctgggggtttttttggtgggggtgggtaagggaaaggggagaataagaccaggggaaatttataggttaaaggagacttaaaaggtatcaaccatctgttacaaaatatagatttattttagtcctgatttgaacaaatcagctataaaaaattatgagacaatctaaggaatttaaacactatctgattaacttaatgataagaattcctattaacagttttaagtggacttttagtattatggtcatgtagaaaaaaaattcctacgtcttctcaagatacaggctgaaatatttgcagatggaaatgatataatgactgagatttggcttaaaataattgaaagaaggggagaggcaggactagccatgaggggacatttatttaggatgtgttatggagggattgggggcaggaggagaaggggacgacagaggatgagatggctggatggcatcactgactcgatggacgtgagtctcagtgaactccgggagttggtgatggacagggaagcctgacgtgctgcgattcatggggtcgcaaagagtaggacacgactgagcaactgcactgaactgaactgaactgatgagttcttgagaattcattatattaatctctctgcttctgtatttttaaaaatcaaaagagggtagtaaaagggacaactttaaatcattttaactactgaatcattgtgagttaaaactcactgaaaaattaagcatactccatatatcacccctgataaataacagtgtcaatctaaagactcattaggccctatctatttaagaaataaaatttccactttatataaaccaagggacttttcattccttaccatattgaagccagctgagcctgtggtaaacttgattgcataagaatagttcttgcttggggacctaaatgaaagccaggaaaaaaaataaagatgaatcagcaaatcttcactgtctaggaagatcagtgttctgcacacaggtactatgcaatctcatgcaatcacagtgctttaaacaatatttgctattacccaatgggcttttcaataaggaaattaagccccagtgaaaaagggaaaaaacacaaagcatagcgcctggcacacagccaataaatttttgttaaatagatgtttaatgaggaatgagtatgtaaaaaataagagtttcaatatataacctgccctttggtccaggtgaccatctctatttgtatcaggtttttattcacaaagctgaaacgtgtcctctctaaatgcaatatcatctgccaccctctgccacctccatcatgatgactatcaaatttagacaagagtcagagaatctcaaaagaggaagtaaccttagagaaaactcttctacccatttcattatgcagacttaaaaaaaaaaattgctcatggttgcataaatggccaatatcacagccatttcctaggtttgtgataaagaagaattcctggaatttcaactttcctctcaaaattagctctcatttcttaaaatacttgtgtatatatcttcatttctggcatgaaactagctttagataccaggaagcctacaatggaagattttgaatgtttaaataaactagtgttaagaagagagcgacaaatgtctcatgtccttcaatgatttccaaggcgtgggcccaggatgacaggtaatagatcaaggaatgcaaagtggtagcaattatgctggggagattatcatgtataatattttgcttggtcttcggtatactggaatgaggaaagttcaccgatcattttatttagtctctaacactgtatttagagggcttccctggtggctgaaatggtgcctgcaatgcaggagactgggattcgattcctgagtcgggaaaatcccctggagaagggaacgctacccactccagtattcttgcttgcagaattccatggacagaggagcctggcaggctacagtccatggggttgcaaagagtcagatatgactaagggactaactctttctttcactgcatttagaatactggcaatataaaagtagaatcagcataagtttagtgaaagctttcatttatacttgtaacaacactgtgcccactacagaactatataaaagaaagttcatatttcacttacttgataaaaaatgtaacaataaactttaaaaactagccctggacctggatatcaggagatatggattccactcttgactcttccactctctaatgacatgtgacattaataaaatcactttccctctctaagaggaagttctttcgtctctgaaatgagggaaatgatctagaacgggaattggtaaaccacagtccataggcgttctccagtcctccagctgtttttgtaaataaagtttcactgaaacatagctatgcccattcacttaacatattgtggctgctttcatactgcgatggcaaagctgaatagttacaacagtgtatgactgaaagcctaaactatttagtattttgccctttaaagagaaagtctgtgatccctattgtcttctgcaattctaatatgggactctgttaagtcttaaggtcaggttaagaaacattaaactagatcagcaacagtgaagacagtatcttagcataacagagcaacctcctgaggaagcctgcattcatgaaaagagtactggcttagaagaaaatattaaggatataaatgaaatctcaagttcacaaagcctataatgggtacccatgattgggcaaggaagcaggaatgtaaaggacagagataattcaatgaagtcaaaagtttagttcaaacaatgactaagactttttagcttctgagattagcatatgaataaccaaataacacagtcactgtttcagaatgcaaggagataataaaatacctctttgagaaaaggactagcaagaatagcagctccagaattctgttgtgcgtatgttagtcactcagtcctgtccaactctatgcaaacccacggactgtagccaccaggcttctctgttcgtgggactccccaggcaaggaaactggagtgtactgccatgccctcctccaggggatcttcccaacccaaggatcaaacccagatctcctgcattgcaggcagactctttaacatctgagacacaagggaagcctagaattgtacagctacttatatcactttgattaaagaagaactcttttttttatgagtgtatcttttaagaccatgcaatagtatatacatcaagttgggaaggaacagggggatacccatctaatgaggtgtatcagataaatcaactcagggaatcttcaccgactcaatggacatgagtttgagtaagctccaggagttggtgatggacagggaagcctggagtgctacagtccatgggtcacaaagagctggacatgactgagcaactaaacaacaacaaccccttattagaaagatttctggacagcatcataaaatcatttgagtctttctgatgtagacaacagaaccttttttttaattcacagagagcatgtaacttaactctgaccttttatacatgaagaaataagatccaagtaggtaaattgaactccagctggtaagtggcaaggccaggttccaaactccccaatcattcccctttcaccccgcccctgcagtcatcactgattctttgagtaggcagtttcaagttgacctccaaagctggacttcagaaggtgaaccaggtttccttcatagcagtgttcctttctagtgctttgatttgcacactcgtggcatttgggatgctgggggatccttggtctaggttctattaccaagaagcaaaagcctgaggcagtggagaatgaagtaactgtggccttatcagttgatgagaacttatcaatcagtcgatgagataaaaggaacaatgaaaacactgtttagaaagaagtacaggtaaatagagcaaagtctggaaaatctttggcccaatatctagaaacaatttacatttagaacggagaccatatttcactaaattaattcttatgtgtaaatacctgttaggtgtccactcatggttttgtcatgactattgaagagctgtctgtatttcagcctggatgactgaggaacagcccactcagctgtaggagggacactgtgggaggaaagacaggaaaagagggtgaacagcaaggacctgcacattccagttctttaaaaagtaagaactttctagaaaactagctttaacattttattccctttctaatcactatttcagaattttccatcatgatttttttcatttcttaaggttacaaccctttctctgcatacagataagctcattattttgagcttcctattactttgagtaaacaggacagaccaagtggctggttcaagttatacatacaattaaactaatttaaaggttctacaaaaggatggaaaatctcctaggaactgaggtgatcacagtaacatccagtcttcttttggttttaaaagccatgtggacagcaaacaaaagcaactgcctttaaaggtattaattttttaaaaatgtttaacagtcttacaccaaaatacatgatggatttcctaatgaagggaagttatttcattctgagaatttacatgcccacatgtggagtttccgagagaggagagaacacttctcggcagcgtagaaaggaagggaaggagttctgctcctgactgcgacgcagggctggtctttcctgccaatgtgtagcacccctgacctcaggaaacccctgaccagcagccagctcgggtgtagatctccctggtgatcagttccttagatcagttcccacacagtatcacactggttgtacccacggtttgttaagagcccgctgtttatatagggtaatttaaacatgatgattgagctgacagtaaaaaaaaatggcattccacttccaggacagattacaactaacgccccatgtgcaatgtcctttcatttcaacaaaaatatctatttctcacatgttaaagtgaatttttaatcctcatttatgtactttatctgtgtccttattcttactatgtacactgcttaaagcacagaaactgctcccaaacacttgaaaagtacttataaaaatttactgtttcaagttttatgtatttctccgtaaaatcatttaccgaggtctattctgctgtgcctatttctgcaacaaatctctcatgttaaactaatattttgcagattccaactcttcccaattcgtcaagaagccaattatctctcccctccaccccaggaatgtaggatataaaacgcaaagtgcctaagactacacatatcaaatcatagttttctgccaaattcctgagaatgtaaacaggcctaaaaaggcatgatccaaaaagttagatgccacatcacacaaactttctagaaacttaagatactgaaggaaactattaaaaaaacaacaacagtgtttttataaccaagcagaatgctgtagggtcttcctcggacagacctctcccctcatgttctctgcctctctcttttttccctctgcctgtctcttgtttgtagaaaagctgtggtctcccaggccccacttgagtcacagaaatctggctcaagaattaatgattgaaaggatgtgaacatgtagtgacaaaagtcacagttgggccaggagaactggtaacaatttaatcagcagatgtgccatatggcagtcatagaatccttagttcctccctgaagtacctagataacagggtctgaggcacatttctgacttgttttacagatgataaaactccaccaaagggaagctggaagctaaggactgataacatcaaccacccgcctcttgctgttgctgctgttcagttgctaagtggtgtctgactctgcagccccatggcctgcagcacgtcaagctcccctgtccttcactagctccccaagtttgctcagattcatgtctgttgagtcagtgatgctatccagcaacctcatcctctgccactcccttctccttttgccctcaatctttcccaacatcagggtcttttccaatgtgtggctctttgcatcaggtggccaaaatatctgagcttcagcttcggcatcaacccctgtggcattgccctggtacctcaccatcaattagaggtgtgcagaaactgatcaaacacactgtgactcccttccttcacctggcctttaaaaatggtcccttgttgggagtttggggtttctgagcgttagcttccccagactccttatctgacaccttacaacctatattcgacaattaaccaaagttactagggcaaattttaagaacatttgccttaaagtcagaaagacctcagttcagctgttggccctatcacttatgagttaccttgagcaagtcacttactctctgagcctcctcattcataacacagagaaaaccatagtcatcttctggagaagatggtgagcattaaaagggttactgtgcataaagcatttgacacagtgctttgcagcttatggattttctttatattaattttttaaaggtaatgaatttttgagttatattcaacatgctcttctctttaaagaggaaacatgacttgattcacttaggaaagattcataaagaggactgaaacaagaaaagatgcaatcaatcatttttatctacatcttctcatttgaaaagttttgagacagcttatcaagagacttaatttttcattttagagcagcattatgcaaggggaaaatatgggtaaaataagaacataaaagataatggaaaccaagactggccaaaatacaaggcagcaggtcacataagctttaccaaaatcgagccacatatccaattaacaagagctcttctctaacttgaataactcatttcataaaaactgatctaagttttgccaacagtccacacaggcttcataagattatctgagataaaattagagccagttttgactctaagtttcatataaaatattttatacataaacttgtttattttacagcgtgaggcacttcagtggctgtggcacacgggcttagctgacccgaagcctgtgggactgaaccgctgtccctttcactggcaggggattcttaaccactgaccaccaagggagccccgacacagaaactttcaaatgaccgacacaaaatagttaaccatggactactacatatttatcatcctcatgggaaaaaaaaaaaaccactaaattttttaaggaaaagtagtgtttctgattctgtcattgctacaacaaacaaataatgaaatctagaacattatccagaattaagacaaatattagcatgctacaaaataaaagaagataagtaaagaacacgtagctaattcattttcaaatttatgagtcaatcagacaacagtttcaaccaaaacatccatttgcaaacaagcaaacttacctggccacatcaaatgattgtgccttctgtaattttgtgtttaactgcgaccctgggccagatctactaaaggaagaactctttggcaatgtggcagctgtaaaaataaatgttggataattttaattctacaaaaataagaagtttcccttttaaaaattaaaatgcattgtcatcaaaattttttgagtcatcaaataatttctaaggcagaaattatttctcccttctgaccattctagactcaaaaacagtcattccctccttgcttcctgccctctagccaaaaatgttttcttgttccttcgtaaaaccaccttactaggtagtaatgtttacatccacaaagttgggctcttcattaaacatttagtatcacattttatagtatctgttcctacagctgaagaagcaatagcttaaatagatagctggcatatttgtaactgcactgaagcagctgaagcatcagttccagagtcagagcccagaagtcacagacctgtctcggccagaggacacgtgatgccacggaaggccagcttctgcgtctgagtctcattcaggctatgtgtcaggagaaaaactctgagccttaaccagcatttctcccaacctggcctacagccttgcaacaatcaccatttgtcacaaaagaaaacaagacacggggcgtggattcactgttaacacgggaaaaataatcgcaagcactttttcagctgccatgtcacctacagtcatggtcacctatgagagacaagctacctgcgacaagaacatcttaaaaacaaaaggtcacagagacacatcctgacagatgtaataaatccaggggcgtaggcagactcacagattaggctcaaacccacactccatcatgactgaatgtactcagacttatctaagtacttaaaagatcaaacaagaaaaaaatttccatattgatatgaacccactcagatttgttagactaaggctatctacatctacactttatgcttttctctgttgtcactgtttagttgctaagttgtgtccaactcttgcgagtccatgatgtgtagaccaccaggctcctctgtctgtgggattttccaggcaagaacactggagtgggttgccatttcctcttctagggaatcttcctgacccagggatcacacttgagtctcctttaggcaggtggactctttaccactaagccaccttttctttaaagggaagaaagactttgaataaagtctcaaaatgaaattagctaagccagacactttgtaatcctttgttcagttaagcaagcatggaatactataagcttaatatagtcattcattagatttccttcccctctatgcctgattcattatacctcttcaaaaaaaaaaagccaatgttctttttttatctcccacataattctactcctaagggattggcttgtttattagcagttcatggcagctgaagaaaggtagtaagtgatacatggaactaaaaagtgttcaaatgctgttcaaacttgagctgctctcatcaagcccttgaaagggaattatgctcttggttttagctgttgacttcacttttgtgcacaatggcagccaagggtacgtaatttcatgccctctctctacactagctgttccccaaaatgagacattaaatgaaaaaaaaaaggttatttcttctggaataaaatactatgtaaatataatccaagtgtgaaaacagaagacttaatgagaatgacgagtaaaatacatatagaacttcagcctgtggctttagcaggtcacataccaggatgagcaaatgcaggcagaggctgtatgaccgggggcgccccattggccagggggggcacccctgctgcaggaacagatgacactagtgggggagacatcccaacaacgggaatggagcccattggtacaggagcaacagcggtcagcggcggcatgctggcaatacctcccatacctatgaagggaaaatcccaataaaattcacatggaaccacatttcagcattcaacaataattaacccaggaatgcatggagaggaaaaccctcttccagtcgtaatatactcccatttaaaatctgaattcagattaatccttttgaaaagtattaaacattgtcaatgatcagatggaaagggctcaagaccccggcttaaagagaaatctactggccaatgttcaccaataataaccacagtggactgaaagccagcaaagggaaatcaattcataaattcacaatgaggtactttttgtaaaaaatcctaattggtcaccagaggaaatctatttattttgaaaactagtaaataaaggcagaaaataaaccattaacccaccttccctttacacactgaatctcagaggaatcaaacatttgatgagaaagtttctgtttataaaagtattctaacaacaaaaaaaaagatagaactaaactaaatgtctctattctttttcctttttctatcctaacttgtgatattgtgacattataagaagtatagatctgatctttggccccaggtccttattcttgacagagctctggcgtgcatgtgtagttgctcagtcatgtccaactctttgcatccctatggactgtagctcaccaggctcctcagtccatgggattctccaggaaagaatactggagtgggttgccatttccttctccaggggatcttcccaacccaggagtcaaactggcatctcctacattgcaggcgaattctttactgctgagccatcggggaggccagaagaactcctaaaatccttttcatttcctgactgataggaacatcttctgccaaaatatttggtcttagtccctggttcatgacacaagagcttttaagatccttggaatctctggagtgggaagactgtcatcttgtgtttgatgagacatcagaggagaatagacgggggaaagtgagctaatcaaaggctgatgatttcatcaatgaagcctctgttatgaaattcccataacaactcctacatgatggacctcatttctgtactgtagtggttatcacattcgcctcacaactcctacacaacaaggtctggagaacttccaggctggtggacacatccaggtcctggacgacagaagctcctgcactcagcaccctttaggacctcaccctacacacctctccgtcttcctgttcacctgtaccctttataatatcctttatagaaaaccagcaaatgtaaatacaagtttcccaaagttttgggagctatcctagcaaactgaaaaagcgggagaagggtttgcaggagcctctgacttgagtcaatcttaaaggaaatcagtcctgaatattcattggaaggactgatgctgacgctggagttccaatactttggccacctgatgtgaagagctgactcattggaaaagacccagacactgggaaagattgagggcaagaggagaagggggtgaccgaggacaagatgcttggatggcatcatcgactcaatggacatgagtttgagcaaactctgggagatggtgaaggacaaggaagcctggtgtgctgctatccaaggggtcacaaagagtcagatatgagttagtgaccaaacaacaactctgtagtcttgactctggagccaagtcaccccagcacttgtgactcagatctaaagtgaggtcagtcttgtgggactgaagcctgtggaatctgacactaacgaccagagtgtcagaattgaatttaattataagatataaagtcagtgtccgcagagttagaacgttggttggtgtgttttttctggatacaaaattcttggccgattccttccttgagaatcttaaatatgtcactccatttccttctggcaggaagaagtcggaagatgctctaattctctttcttgttagccatgtgctttctatttgcttgtgcccaagtgactttttgttttactagaatgaatcctggtcttgatcctctccaggacaatattcctaggcacgtgctttatttgttcaaatttagtttcaaacctgccgtgtcaggaaagctgttctcatttcccttcccttgctctggttttcttcttcagaggccccacctaaccagctagtcagttcttttcaccttcatcatttggcacttgttctcaaattctttttgtctcttttgtcgtttccttttaatgctcgaaactgtcctctttttttttttgctttctgtttctcttcagtctctctcgtgctgcctctggttcactcttcatttctgaaacaactttttcttttatgtctcattctttctggagcggtcacctgatttctggagttttaaaaaattcggatcgatgccagtcgttcatgacttgcaccattttcttagcgcctctcggcttgttttgaaatagtcggtcactggtgcacagccactgtccgtgagagtgctgctggtctctccgttgtctcctctctaataataactgtgtgtgggatttgaccctgcctgatgctgcctgttgctccttttgatgtgtgagcctggcttcctgggtgggttcagtctcctcccccatgtaggtctggaccttctcatcctcctgtctctgctaccctgccctgtttaatctttactcactcccagtcattcctccttggtgtgggatctgatcatcaaaggcagccttgtcggtcagtttgaagagtccatagggaccagatcttgcaagtcttctaatccagggacaacccccatcattattgtcttaacaccatgatttgtccatttcagttacctactcagcttttaaattgcccctcttaccaagtgacggcctcttctgaatgaatggcattttctggatacctctaaacaaacacatcccccaggcaaggttttagatgccatctctcttaattcatgaaattttccacactctcctcaaccactgagttttccctttgactctaaaaacaccggagcctttccaaccatcaacatgctatccttaagctgacaggttccacctcacggttaaacttcccgccctcccaggcctccagcaggcttctgtccctaccactccaaggaaactgctcatcaaagtgaaagtgaaagcgtaagttgttcagtagtgcccgattctttgcaaccccatggactatagccggtcagtctcctctgtccatgggattctccaggcaagaataccagagtgggttaccattccaggggatcttcctgacccaggggttgaacccaggtctcccgagttacaggcagattctttactgtgagccactagggatgcccaagatcaggcccaaacccatcttatcaaatgtcaaatccaatcactctcgtgtcctattcttactcagtccctcagaagcaactcttccctggtggctcagctggtaaagaatccacttgcaatacaggggaccccggttagatttctgggttaggaagatcccctggagaagggataggctacccactccagtattcctgggcttccctggtggttcagatggtaaagaatctgcctgcaatgtgaaagagttgggttcaattcctgggttgggaagatcccttggaggagggcatggcaacccactccagtattcttgcctggagaatccccatggacagagaagcctggcaggctacagtccacggggtcacaaagagtcagacacaactgagtgactaagcacagcacagaagcaactcaaacatggagacccacacttgaaacaaggtgtgatcttaagtgttctgcatactctagctacactctgtccacctaaatgaagagggacactgaatcaccggaagttgagcttatgcaggaatagcagaagaattgcaattctgatgtctttcttttttttctctctcttggttgggaggcatgttggatcttagttccccaaccacggatcgaacccgtgccccctgcattggaagtgatgagtcttaaccactggaccacgagggaagccccaagaattgcaattctagacataccaactgtagtaagctacaagtgagtcctttgagggtttggggtgggctggatttatggataaggatcataaagaggagggaattcagttagaatccaagcagtaagttcactggcttgaggaagaggagaaactcttggtggaggttcatccgtcaacagatcagtttccgttttctgtaaatccctgatcagtagtacctctgttcttaagtttcattttcctgaggattcatgcatgagattctccactgtatatatcctctggttccatttaagattgaaatcctctcccaactttctctctaagatcctgtatcagtcccagggctttcgttgccatccatactcaaactcaccagagctgagaatccttcctgcgttgcagacatacagatttatctgcctccctaatatctcgacttcgaaatcagcaaggcccttcaagcctaatatggtcaaaatctgacttacttttcctccacaatacaggatatgatgaagctaattctaagctatttttcacattgattaccactggccagatctagattaccataatctcttgcctatggaaaaagcctctttattgatgctcctgattttaggcttgtcccctgtaatctagtcttcagataacacaaatgacaaaacaacaacaacaacagaaaaaacccacacaaaaaaaacaaaaccatcttcagataacatagattatatttttttaaatgtctatcagccatttacaccctgttcaaaagctttcaactgaacttacttagaaaaaaatgctagctttttagtggtttcagaggtaaagaacccgcctgcaatgtgggagccctgggttcaatccctgtgtcaggaaaattccctggaggaggaaatggcaaccgactccagtattcttgcctggagaaccccatggacagagaagcctggcaggctgcagtccatgggcccgcaaagaattggacatgactaagcgactttcagttcacttagtggttttattaggtcccaaaccacctggctcctactttacctcccgacctgaagccctaaggacaccaggtgcaagcctctcattattgttcctctgacacaccaagctttgccttaggacccgttgtttttgccaggtgggttctcttcccccacacctaaggcagctcaaaagttattgcctgggtaaattctccctaaccacctggtctcaggagaaataacaataacctcagatacgcagatgcagctctgtcataggcacccttatggcagaaaacaaagcggaattaaagagacttttgatgaaggtaaaagaggagagagaaagagcaggcttaaaacaacattcaaaaaacgaagatcatggcatttggtcccatcacttcatggcaaatagatggggaaataatggaaacaatgacagactttatattcttgggctccaaaatcactgtagatttcagccatgaaattaaaagacacttgttccttggaagtaaagctatgactaacctagagaacatattaaaaaccagagatattactatgcctacaaaggtccatctagtcaaagctatggtttttccagcagtcatgtatggatgtgagagttggactataaagaaggctgagtgccaaagaattgatgccttcgaactgtggtgctggagaagactctcaagaatcccttggactgcaaggagatcaaaccagtcaatcgtaaaggaaatcaaccctgagtattcactggaaggattgatgctaaagctgaagctctaatactttggccacctgatgcaaagagccaactcactggaaaagactgatgttgggaaagactgaaggcaggaggagaaagagatgacagaggatgagacggttggagggcatcaccgactccagggacatgagtttgagcgagctctgggagatgctgcagcagtccatggagtcgcaaagagtcagatacaactgagtgcctgagcaacagccacctggtcctctctgcgcctctcatgagtacatgggtgctgagttgctttagtctccactcttttcaaccctatagactgtagcctgccaggctcccttgttcatgggatgctccaggcaagaatactgaaatgggttgccatgccctcctccaggggatcctgacccagggatggaacgcaggtgagttctttaccactactgccacctgggaagccctgggtctctgtcatgtcaccctgtttcacagaactatttgtctatttgtttcttcccctaacttgccaacaagttccatagtaactggggtcacaatgttttactcactacccccttcccagcaactaggacacacagtcgggacttaaagatattgattggtttgacccagtaaaactgtggactctggcaaaaaacagaaacaatcacaacaacctctccctgaaatatctgagttcagagtcaaagaagaatgatgatgtgtgcaaatacactgaagggagaaggtacgaggcatactcatcacagaatgtcctggaatacggccaggcacccttaagcaaatcacagtatcactgcaccccattttcctcttcttaacaaaatgactattcaacctctgctgctgctgctgctgctgctggtaagtcgcttcagtcgtgtccaactctgtgcaaccccatagacagcagcccaccatgttccgctgtccctgagattctccaggcaagaacactggagtgggttgccatttccttctccaatgcatgaaagtgaaaagtgaaagtgaaatcgctctagccagcctaaattccacggtgcgttaacatttgcattaacctcgggagagtgatgaagccctgtgtcactctgatgatctggtgataatgaaggtgggaagagagaaggaaaagaggaaaccaaaggccttgaggacaactgagtttaaagaggctctgcctccctttcagaaacatgaaataaagtgttccttgtgagtcgtgtgtgactctttgcaaccccatgggctataaccctccaggctccatgggattctccaagcaagaatactggagtgggtagccattcccttctccagagaattcccagggagagacccagggactgaacctgggtctcccaccctgcaggcagactcttcattgtctgagtcaccaggggagccccttggaacatgcttaggtgttcaacttcttggtatctcagttctctcctttgtgtaaaagggttgacaatccgttgcacactttcagggttactgtggtgaccaaaaaacacgctacatgtgaagacagaccacagggctagaaaacccatggtcagacaaagtctcatactaattataaaatactgataatagtaataagttatgttttcaattagccagaagaatcataagaaaaaaattactttggcaaaggccagatttttgagtaaacttgggcaaaagtggggattgggaccatgtacttttaacttctctttatcgtctgttattccctcacaattaatcctctggaaaaatttactgaggtcgatgtgacaagaatgatgggaggaaaggcagtggaggagccaaggggaagagctaaggtctgaatggcaggagggcagttaagaaatcccagcttcccagagacctcccttggggttcagtggttaagattccagcgctttcacagcaaggggcacaggtctgatccctggtcggggaactaagattctatatactgcgaggcatggcgaaaaacatttttaaaatatttttaagttaaaaaaaaaaatcctgcatatgtatacctgtggctgattcatgttgatgtttggcagaaatcaacaatattctgtaaagcaattatccttcaattaaaaaaaaaaaatcctggcttcctttagaggctgggcaggttacttaagtgactgtaaaaccctctgtacaatgatggcactgctcctgaaaataatcagcagtatccctagagctgaaattcctacagcagaacggaataagagaagacatattacatgtcagaggaagaattactgacacctgggtttgagggaaaaagaggaaatgggatgcctgtggttatctgaccctttctccacatcaaggtttcttcttgcagcctcggaagggaggccaaaagcaaaccaaacaccctgtagttcttttagctacaagcaccgtcaggcattcgaagcaaccacccctttgaaataagctggttaacagagggctcaaaactgggaatacatggtggaagatggccagggagggcgctggtccctcggagcagcccacagcactgttcacctctgcccttccacctctagctctcgtgtgactttgcattgttcctccttctcttggatcactgtcttatttgcctaacccaaaacctggacctttcttctaacatacccagacttgtggcacaaactcactgaaagaaaggcaatgcacagtgtgcttttaacagtgaacctcttaagaacaccatttatttatctcagcttatcattaattgtgggcttcccaggtggctcagtggtgaagaacccgcctgtagatacaggagacgtagaagatgcgggtttgatccttgggttgggaagatctcttggaagaggaaatggcaaaccactccagtattcttgtctgtaaaatcccatggacagaggagcctggcagattacagtccatggggttgcaaagagtcagacacgactgaggacacacgcatcattaactgtgtcagagacaacctgaatggctatgattgccccctcccaaacctccttcactttatcacctgtcatcagatatattaggatgaagggagagagggaaactctatccaccatttttctgttttgtttaaactgtctaagaactttcccaagaatcacgtgttggatcttattactgtaatctttaaatcaagctaaataattaaagcctagggtgagaacagagaagaaatcagaactgttggggacttccttcatgatctagcagttaagactctgctagcttccacttccctggtggctcaattggtaaagaatccgcctacaatgcaggagacctgggtttgatccctgggttgggaagatgccctgaggcagggcatagcaacccaggccagaattcttgcttagagaatccccatggacagaggagcctggcaggctgcagtccatggggtcacaaggactaagcgactaagcacagcacagcacagcttccacttcagggggcacaggttcaatccctggtcagggaactcagatccgacatgccacacagtaaggttcaaaaaaggaaaagaaaaagaaagcagaattgactatgatcttagtcaactaattatcatttaattttctttttttctttttggctatatcatagggcatgtggtatctagttccctgaccaagaattgaacccatgctttctgcattggaagcttgaagtcttaaccactggaccaccaggaacatgcctaccaattaatgtttaagaaaaatatctgactaaaagatggcattttatggaattatgttttaaattgggataataattttcattcccccccaccgtggcattttgtgtgaagaagtaacataatgtaaccaagtgcctcaactattattacaaaaatacatttctcttgatactataaacaaaaggagcataaggaaacaaaacaatgctccaaaatacacaaaaccaaagggaagtatgtgaagatgtgaagaagggtcaagaatccaataggggcaagaaagagagaaaagatgcaacagacactgcaagtttattcctttttccctgacaatctgcacctttgctttcatttctttctttttttgctttctccccttccagcattatctttgtgcacagggccatcatttttcagagtgaatgtctcctagaatttcagtgccacaaactgatatggcagggagaaggaaatatttattttaaaaacatacaatgaaatatatgaactgattccttttagactcaccaaaggctggtgcactagaaatagcaactggttgctgtttcatgacagggggaagtgcagaggggagctgatatccttggagcttcagcttgatgagtttcatagcaatggaaaactccacttgatccatccttccatcattattcatatcagcgagcgccctgcagaacaacagcatgggctcagaatgactgtgaccttaaaagaacctttcccaaaccaccagtcccacccacacaaaaactaaagagtcagctcccttggtcccagagaaaacaaaacaaaacttgtttaccaagctgtagggaaaaactgaataggttttacataactacgaattatgttttactgtgttagtcttcacttatacgcatgcattatttatatgatacacaaggtaattttcagtctgaatgtcaggacatatactatggacaccaaatggagcttgtttttggagcaatgaaattgttctcaattggatattggtgatggttacacaactctgaatagactaaaaaaacactgaactgtacattttaaaactgtgaattttgttaagctattatgggggaaacaaaggtatttggaaacaagagtttatttctagattcttgattagattgcatcaactcatctatggggctctacaaacctcaccacggggatgtgacatgctatgctctactataatgtaatactggcatacttttaaagctgtgaaaattaattaaatgagcttacaaacacactatctgaaagtggtgttcaaacatgaatggtcaagcacaactttcaataagctgtttatagagtatttttctcaacaaagaataaccaaacagaagaacagagtctggacttgcaaccggaaactacgctttggcaaactgaaactgcatgtgacttaacctcttctgtacaaaaaatggtccttcggatttcatttgttgaagtctagatatcaaaggcctaaagatttattttttaaaacctgtcttaacaaaatttttatttgaaacttcaaatgttaagaccagttactccaattaaaatacttaatccttagccatcttttaaatgagccacagactgtgtccacaaaagaaaattacattacgtagaaaataaccccatattggctggagttaatgcaaagtagtaaaacatgaggcacagagaaaagtgtcataaaaagattacaaacctttaaaaatgttaaaaattctaaaagtcaacactatctctcgggaaaatttgtaaagctcataaaatcataaaggaaacactatggccacacgaaccatccttctgcctcagataggagctcccctgccagcaatgagccctctagcaaaccacaccatggaacccgaatttctctcactgctagcggcttcagcatcacttgccatgtttcttgagcatttggactcatgcgtctatgaattgctcattcacatcctttgccaagttttctgatggactgcacatcttttccttgtcagtttaaaagagctcattgtacgttacacatcaactgtttatctgtcagttgctgaaagaattttttaaacttgatccattttgtgtaattcttcagcatacagaaattctacatttttatacatgtaaaatatttctttgatcacatagctttcttttctgaaactgtattactttattacatttcaacctttaaactgactgtaattgcatatatgtgtggtatgttaccccagggttcaatcagatttccatcagatagatggatacttaactttcccagcaatgtttaggaaccaatccattcttttctcgctgaagcataaaaatatttttgtggtttattaaatgtttatatgaaatgagatctatttctggattatctactctgaataatttccaggtcaacgtgacaataatctgactgcactgactccagtatctggcaagacttatttaaaaaaaaacttgtgttgatgtttggcagaaaccaacacaaacacaaaacacaacacaaacaaaaaattaaaaaaataaataaaaaacttgttggatgaacctagagattgtcatactgagtgaagtcagagaaagacgaataccacatgacgttgtttatatgtggaatcttaaaaaaaacagaaacaacaagagtaaaatgaacttatctacaaaggagaaacagagttacagatgtagaaacaaacttatggttaccagggggtcaggcagggagatgtaaattggaagactggggttgacatatacacactacaccatacaaaacagataacggataaggacctacagtacggcacagggaggtctacacaatgccttgtaacggcctacacgggaaaagaatctagaacagagtagatacatgtgtatgtgtaaccaattcacttcactatacagcagaaactaacacaacactgtaaatcccaagaaaagtgtttttaaaaatttgcttggctattcagacattttttttcccctatgaactttaagataatttatctattctataaacaactttcttgaaatccaagatgaaactgcattagatatattaatttttatagaactgacatatttatgatagtttgtccaaagaaaacagtacattcagttctcctgatgttaaaaacattacatcactttctccatataagtaattactattctcgttaaatggggtcttaggaattttatcatttctgtcactcaaacagaacaggttcctcatttccatatttagacgcttatgtcaagcacagagaacaattttgcttttaataatcatttctgctggctgatcaatcttaccaaacttctgtgaaacttacacaatcacctaaacagcaaaagagttagctttcatttcctatagttttacccttcctctctttcactgttcttactgtctccatcacattactgagtgggcattccagtgtagttctgaatttaagttaaatggctgtagtgtttcactgtttagtgtaatatttggtactgatttttagaatgtaatctgacatatttaagcagttccctttttctactagaaatgcttgctatacattttatcaaatgtttaatcagcatctgaagacctgatcacacacttctttttccttttatctgctgatataatatggatttccctggtggttcagacgataaagaatcagactacaattcaggagacctggattcaatccttgggtcgggaagatctcctggagaagggaatggctacccacttcagtattcttgcctagagaattacatggagagaaggaacctggcagggtacagtccatggaatcgaaaagagatggacacaactgagcgaaataatgttgagggaattccttgaccttgaactaatcctggcataaactcgagttggtcatagtttttatacattgtagaattccatttgctaagattttgttttcatttttctgtgtctatgatcataattgagattagtttctggttgctttatttttagtctgtttttcaggtttcataaagtaagttgaatcaataaaatgaaatggtgagctttcttttaccaatttttcttttttgggggacactgtgcagcatgtgggatcacagttccctgaccagggatcaaacctgttgccccaccccacagtacaagcatggagtcttaacccctagacagccacagaagtccctcgaatattttttaaaagacattcaggtatttcaaatggttttcacagatataataaaggttcccaatgatcaatactgacatgcatactttacaaaaaaaaaaaaaaaaaaccagcagatagattcctactttctattccccacactactgctcccaaaacacattttctagagagaaacaaaaatatctagtgtgggataatgagtgggttaggggaaaaagactttctagtaatgacacaattagcaaaagcctggatgggagaggagaggaaacacgtaatgctcaggttctaaacattcactaaaatcccaaaacatttctaacaattttgtgtgaattttttaaaaaacttcttctgctcaactaacataacatagctgttgggattccttggtagtaaaaattcaaaggtctttttagaattataacagttactcctacaaagctcaactctctccaatccctcctaagacactggaaaagagtcagaattctatttctcaaattttctctgcaaaatatgatttcagctctgctatccacttcatctcctgtgtgtgtatgctcgatcacttagtctgactctttgcgaccccatggacagtagcccgccagactcctctgtccatggaattctccaggcaagtgctggagtgggttgccatgccctcctccaggggaccttcctgtaccagggactgaacccctatctcctgcactggcagatggattctttaccactgagccacctggggagctcgctttacgtatgtatagttatttctcagtttactcagttctaataatcaccccagaaaactaactaaaagtctgagaatcctgaaattaaattcacacaacttccaaagttaaaaaatgtctgataaaaatatttttaacaaaaagtgaaacaatatttatgactcttgaatacaaactgatcttaaacacgatgtttagtctgatattaaaatctatatataataacaggcatggtggagatgagaaaaggtccacaagtatactgtattaagggtaagttttttgtttgatttgtacaaataaaccacacattgctcttatatcctatgggaaaaagtgcttcaactccaagcataggaaaatctggcaacacctgcagaactacatatagatttactctttgatgcagcaactcaatcctatgaatttaccctgaaggtacacctccaacaatacaaaaacacatgctttagctcattcttcgctgcattatttgtaactgtaaaatattagaaataacccaaatgcagaaaacataggaaactggttgaataaactatggcataccattcacaataagtattacataactgtaaaaagaaaatataataaagatctctatgcgatgatatgagtgatttttaggatatgctgttaagtgagaaaaggaaagaacaaaagaacatttataggaggttactttcaaagcagaaggaaggggaaataatttaaattcacatacatattagggacacgttttttccccacagaaataaacaacaaaaagataataagcttttggaaccttgctaatgtgttacatattcaaaaattaaaattaagtccacaaagatgagagcagatccctgaactgaataaaaactaaaccaaataaaactggggttgggggtgggggtggataaaggagattgggactgacatatacatactaccatatataaaacagataactaataaggacttgctgaatagcacagagaactctactccatactctgtaatgacctatatgggaattgaatcttaaaaaaagagtgatgtatgtttatatattaactgattcactttgctgtatagcagaaactaacacaacactgtaaattaactatatttcaataaaaattaattaaaaacaaaacaacaacaataacaaagaaaaatacaaataaacctagtagtattttgaatgagtacatgtccacataggaaaaaaacattcaagtaacttctgaacacagcacttcatacatcctcagtctgtaaacaaaagaactatgaggtaaccttgaacgccactgaatgggtttggggtttgcggtggacaggcgtgtagctcttctgtaacttacctcgtctgtatcacacgattcagaggaaagaaggacctgtctccactccacctcattcactgcatcagacagttcctttaggaggccacctcacccacaaaggctcatcacaggctgctcacctcccctgtccagattaacctggcccagtcactcaccatctctttgtttattcacacaacaacaacaaaattttgggctttgcagcacagcttgtgggatcttagttccccaactagggactgaactcaggtcacctcagtgaaagtgcggagtcctaaccactagactgccagggaatttcccaacaaatagtttttgaaaagatcacttactaaggtctccattcaggaactgggcttacaactaaggtaaagacaggcaaagctcctgtccttgtttcagtgtaagcagacactccacaagaaaaccagactactcaacatattgataagtgctattaagaaataaagcaaggggacttcgctggtgatccagtgattaggactttgcctttcaagatagtgggtgtggattcgatacctggttggggacctaagattccacatacctcgtggccaaaaaaacccaccaaaacataaaactgaagcaatattgtaacaaattcaataaagactggttcacataaaaaaatctttaaaaaaaaaaaaaagaaataaagcaaagcaatcggaaagagaagatgttggcaggagcaggtagggagagggaaaaattttatttttttgcctttaaaactttttgttttgtattggagtatagctgattaagaaacaatgctgtgatagtttcagtaaccagccaaggaactcagccatgcatatacatgtatccattcttccccaaactctcctcccatttaggctgacacaccatattgagcaggattctctgtgctatacagtaggtccttgctggttacccattttaaatgcagccctgtgtatatgtccatccaaaactgagaggaaagtactttagacaagtgctcaggaagcccttctcagggaaggtgacccatgaatcgaaacctgatgggtaatcagccagatatgtaaggatctagaagagctgcaagacagggagagaaaatgccaagtgcaatgaccctgaggcatttaaagaatataaacaaggtcagtgaaaccggagtgcaaaaaattaagaagaaaatggtacaaaataaaagagggaaacagccaagagcccagttcacatgggcctatggccttggtaacgactttgggttttcttattaatgaagagttttaaatggatttaccttttggcggggggcaggatttacttttttgaaagattgttgggttgctgcttggagaatggaatctaaagggacaagtgtgaaagagagactccagtcaggatggtcagatcgtgggcacagttattcggcccactgtgacaaatcaggatggtagcaaaggagacagaaagtcaggggccagattggggatacagtctaatgaagtcaaaagtatacgctgatagactggttgtacagggtaacgaaaggagagcaatcaggcatggctcccaccagctggagagatgctcacgaacatgaactgagatggtgaagactcaggaatgttctggatgacttctgggggagccagggactttagcaaactgatcttgctgggggccgaaggccctcctgacgtatgttcagaggttcctaaatggtatcctaaggggtgactgccctgatccctgcccctaatttctgcctctggcttcctcctcctctctcggggctgtttccaagcagtgctccctctcttcccctcacttctctccttaacagcttctgtcccctctttccatggcccctaccgcctctgattccaaagccctcattcaacttctttgtcttctctctacctgtcttctattcaaggctcttgtccattgccctctgccttgttctctcctgtctccacacgagcctaaggttggaacgatgttaagcatttaagttgccaaaagataagaggatattggtagctttcctttcagctccttagtagtaagacaatttctagggagaggaatcatctttggttactgttataacttggctttaaacacactgacttgactccatcctctgagggagaatttaggatttcctgtattcttaattagaaactggactggacagatacgtatctccaaagtattagtaggttacagttccaaagctcataaataaattaactggagtacagtttctacatgaattctaagagatattccccagcagcccccatcacgtctacatttcaactgtggtctagagcaaagaaagaaaggcacaaagagaaagagaaactagaaaaagttcctaattctcaatacaaaaattttcttcttctccagaggagtggcacagactgcctaaaactctatagactcaaacccgctcctctaccaaaaggggaagggcttcttttgaagcctttgaccttatcagaaaaaacaagtgagaacacaagattagtatcaaagatagggaggaaaacctacttcatcaggtcagctgttatttataaacttaaaaaccaaaacatgaagaggtgaagtactgctcaggcttataaagggaacaagcaactgtgctgtgtgtgcgcagccgctcagtcgtgtctgactctgtgtgaccccagggactgtagcccaccaggctcctctgtccatgggattctccaggcaagaatactggagtaggttgccatttcctcctccaggggatcttcacgacccagggatcaaacctgcatctcccgagtctcctgaattggcgggtggattctttacccattgagccatctgggaagccctgaagaagctggtgctaaaagacagatcttcctcacactctgcatcacaccattccagcatcttagcaggacatctgtgcctcataaaatttacaatgacctttcaaagctatttcttttgggaagatacttaaaggtgtgttttttttgatttgggggtttttgtttggctaggaaggggtcttagttgtagcatgtgggctccagttccccagccagggatcaaaccccagccccctgcattgacaatgtggaatcttagccactggaccaccagggaagtcccaataggtgtgtaagtgtattttgttttgtttcttccccctagtagtaattctcgatgcaactaaaatatgccaccacaaatttaacagaatgtcagaaaagaaagataaaaaacattttggatttaacctaagtctgccaactcattatcttcactattaacacaatttttcacaatgaaaagaaaaagttggcaaaaattactttagtgtactctggtaaacaaaacagaaacaaacaaacaaaaaaaagcagttttgttttgttctttttttatttttggcttgtggcatcttagttccctgaccaggaattaaacccaggcccccagcagtggaagtgcagagatgtaagctctggactaccagggaattcccctgtgccccaccccaattcctccaccaaagaaaaaaaagtttggaaaattaactgtgttaatggaaagaagtgaaatttattaaataatactttgtttttctccattacacttattaacatgtgacactttttatgctgttattgaccatctccttccactggattacaatctctatgaaagcacaaattgtgtcagttttgttcacagctatgttcccagcacctacaacagtcattggtccataggagacatctgacagatatttttccactgctgagtgaacaaatgttaagtgagatctccttgcagtaattcatcacaagactgcttcttgaatgaaccttcacagattgtaaatacagtataggagcagaattcagtgaaagaaattaatctggaaaaagaagagtctagtgagtgaccttggttgattgcatgaaacataatcaccagaacacaaagcagaagtttaacacagacgtcacaagtctttcccatttagacttaggcacttaacagggctgccagtgcaggagatttaagagatgcaggtttgatccctgggttgggaagctcccctggagcggggcatgacaatccactccagtattcttgcctggagcatcccatggacagaggagcctggcaggctacagttcatagggtcgcaaagagtcagacacgactgaagtgactgagcacacttaaccaacatgtcagtgacactgctcactgatacatgagtgttctctctgtctacctgtctttgtgtgtttttctctctacctgttacttgatttcaaaaaccttgtttgattgttctgcttcaaatagatcagaacttagtacaagaagggtataatagttaaagggacagtctggcagccaatatgctgacaaccaggaaaaagagaacaaagcagacaccaaaaaaagcgcaggaatctgggtatcatttaatttcaattcaaatatatccactcacaaataatacataaattcccatgtaagttttgttatgtcagagcacagtaaatcattttcatactgatgacttataatcaggcttatgtactgtagactccacttaaaggcaataaggaactacgtcaactttattaatttccataaaattaaaaatattttaaagttaatgaactaaggggacaagcaattggttgggtaattcagtcaacgtggaacacccaatccctgatgatgacagcaggtaccttcctgaagttttgttttgaggacctgtaatgtgccagggcccgcactaaggtctttgtatacagtttctctgctaaaccactcaatactcctataaataaatatgcatcttcccattttctagatttgaaaactgaggctgacagggagagaataaatacacgttccaaaccataaagatagatagttgtacagatgacactacagcaagctgtctccacaatactaagaaacccagggaaatgaagaatcaactgtaagaaccatccattgcaggaaagcatggcctcttggccaaagaattcaccacagcttcccaaagtcatagacctagtacccaaaactacattggccactctttttcattcactctttttccaatggtttcaaaagactgggtacttatttgtgccagttaatcaagggattcaccaatatttattatgtgctcaccttgtacaacattgtaataaatactggttttttcactctttcattagttatttccctattgagcctcaaatattttctttgccttttattcagtgaaagatacaataccatcacattacaaaccaagaaatgtgggacactcagttgagcatgggtgacgtgaatgaagccaaaacaattggtgagaaaacattaaaatgcagatttctcaactgggaagtcaaatttacaacagtgttatcttgcaaatgtcaccactttttcaagttccatatcagaaagataattttcagaagtatttctctggtggaagcatatttcagactagagatacatgttttccttcaataatttaagaaattaagattagatattactgaactatttttttttacaaccttctgtatatatgaagctccaacttaccatatctgtgctaaaacaggctgaggtaacccagattgaaaaaaaaagtttctagcttgatcacctgtaaattaaatggataaagttttagaagaaaatagtggatgacagaaaactcctatgtcaaaattacaaaaatgaaagaggctaataatctagtaaatacgaaacttaatacattttaaaagccaaatgataagtttgtaagtaacaataaaatgaatacatcagcatggactttagaacgtaacacttaaaaaaaaaagtgtgtaccattatgtaagggtagactgtctatgttaataaatctgctagtaattaaaatggtaacagctacatattatgacaaagtgtacctccaggaatccccaggaaactgatgacccatacttctactttacaaaagggttctttgctattcccatttacctacacttcaaattattggtactgctaacatatttatggagaatgagtaacagtgatcaaaagaatgacatcaatgactaagaattaataagttaaagagaactgagacaaacatacacaaaaacaagtctccaggaaatctagatttcattttctctaaagctaattcctgaaaagtaatcaaacaggaaagaaactagaaaaggcaaagtacaaaggcatctttaaggacacagtaataaacaaaatgtttttaaatgttcatatctcttaatttactcaagtttctcaagccaaggtcaaggtcagaattaaggaagtgtttttactcaaggaccacagtccaatgctacaattacttaaagaatgtatccattaatttcaccaattcccaccagtgatatggctaaaacagtgacttggcatccattaaaaactgcagaaaggcttgagtgcatcggaggaaaagtaactgtgaaaatacagaatccaggctaagtcaaataagtaaagtacatctttggtcataggtgccgaccttcactctgcataatagactttccacagatatatgcactacggtaagtaaaaatgtaaaaatactgactccaattaccagtaataaatccagatattggctttaaactatggaactgttgatcatgctttgctctttcctctacagttatggcccaaatatccaggctgcctacaagccaaagaaaagacaaaggaattattcaacgaaaaaagaaaaacaacatgctcacacacagtttccacaacacttatatggtcagtatattataaaccatttgataaattaccatctgtttgtccttggaagttgagtagacacatacacagtactatgtatataatagataataataagaactatacagcattggaaactctactcaatactctctaatgtcctaaatgggaaaagaatataaaaacagtagatataagtctatgtgtaacggattccctttgctgtacaacaccaagtaacacaacactgtaaatcaactatactgcaataagataactttttaaaggaaaaaaaaaagagaaaagtaagagtaaagcaagcaaagaaaaaaagacattaacatacattctttgtgaaagttatggaaaaattgagcttcactaaattagtattctagttgattccatgaaaatctttttggagtgataaaaatactcaaacactagacttcagtaacttttatagaatgtagattataattcactgaaactgattttaaaaatgggaaatgagtatcttggggggaaaaaaaaaaacaatgacaaaccagagaaaacagggttaagttcttcagtttcaactcttggactgaccagatgttccctcatttctgagactgtcctcactttagggctccaccaggctcctctgtccatgggattctccaggcaagaatactggagtgggtagctattcccttccccagggcatctgcccaaccgagggatcaaacccacgtctcctgcactggaggcagatcctttaccatctgagccacgaggggagcccactttagttacgaggtctcctcacatgaattcaccaaaataactcttgattacattaagaaaaaggctttcaggagttcagacgtcttcccaaatagtgggaacagacaatacgtgacggggcaggtctgatgacagtgatggtcagcgcagcaattcattccgtccctggaaacgtacttgctgaaagccttgtatgtgccaggcactgcgacagacatcagggaaaagagggcgacccaggcagatcagatccctcacaggtcctacagtcctcaacgtctggggccctgtcaaaattcgtcgagtaaaagcaaaccccaacaaacaaacaaacaaaacaaaaatgtgctcagtgattaagaaggaggacaaagacaaaacacaaaataaaatagtaacatgaatggttttgaaaagattgcagatttctgcactaagaatcccacagagacttttcctgacgtgatctcaggaatgaggctttgggctgccttactctcttcatggtgaccaggtgtgacagttgccaagagatactttggcaactgtatctctttaaaacaaaacaaaacatggccagtaagggaaaccaacatttaacactttcctaataatcttagggaagattacctgaaaagaaaattttgtgcagattgatgtttcaaatagataaactaaagcaaaacaaaaattgcatgcttcaaatccagtcttccaaacaaagtacagaatataaatgacccagtaacctgaacaaataaattgcagaaaacaacaaatcaaaacagagatgggggaggggggtggttcactaacaaagcaactaaagagacacatgaactaattcactgtgtcttgttcagatcctgagttgaaccaaactgtaacaaaaaagtaacacctaaggaatatcagggaaatttttaacagtgactctatagttgagaacattaaggaattactataaatttcattggagtggtaacagtatcatagttatatctttaaaagtgttaccttttagaaatgtccactaaaatgtctgtggatgaaatgatctgatatatatatatgcaaggtgctcaaaagaatccaagtgaatcaatattgaccataagttgattgataatcactgaaactatgcaatgggttgagtgaactattccctctatttatgtgaatatttgaaatctgccataatactaagtttttaaaactacagttccaaagtacattaaaaaaaaagaaaaaatctttgaaaacttaccaccaaagggtgtgggaaactgagccatggttctgttactttcaccttgctaagggacgcctgcaattgaaacgcaacatttaagttcatgaaaacttcacttctaggtacttataaacacactgacaggctgtctttaatgacctgaagactgacactagagctaggagataacactgcaaatgaaggttaccactaagggttcattcattcattccttctctgcacagcttcttagtcccgggtgcagtgatgggcactaaggaatgtggatgaaagcctctagggcaacaagaaactctcagtctggtgagtgatcctgtactattatcccactcattgcattgttgaatttgttattttttaaatctatctttttcctaaccaccacatatactagtccatctgcttgatggttacaacaactgctctttttcattagcactagtacacgcagtgcactgtcttaccttcttcttttttttttttggtgactctttgcgaactcatgaactgttatcatcagcaacagatgctggcagtcatttttcctgaagcagcagacccacttcatttttgagaacacacacacacaggatgttctcagtcctgtctgactctttgtgacctcatggactttagcccaccaggctcccctgtggagtattccagtcaagaatactagagtgggttgccatttcctcctccaggggatattccagacccagggatcaaacccatatctcctgtgtctcctacgctggcaggcagatgctttatcactgagtttcctgggaagcccaagtacatgctgtgaggcatgaggggaaaaaactaaaataaaaaaatctgaatacaaactattaaagaatttccatttgggggacttccctgatggtacagtgcataggaatccacctgccaatgcaggtgacactggttagatcttggtctgggaaggttccacatgccttgaagcaaataagcctgggcacaactcctgagctggtgctgagagcctgcactctgaaacaagagaagccattgcaacgagaggcctgggtatcacagtgaacagcagccccgctcacctcaacgagagagcagccctgctcattacagctagagaaaagcctgcgtagcaatgaagacccggcacagtcataaagaaagaaataaagagaaccgaatggaacatctgtgaagtagttagcctggaaaactaaccagagtgaagctggggggtggggtgtactgtcccacacaataaaagctctggtagacaaaaaagaccacagaagggaaaccagtgggtttgttgtgttaaagtgttgaagcagaccacaagaaaactgaatgtgggaaataagtaatagaattttgccagataagcccaaaaagcttttatttttgtacaaaaaagtcaagtgtaagcatttatcaaatggaagttgaaagtcttatattaaaaaaaaatctaacagtgaggtttaaaaacacaaaacaggagtgagtgaaggcagaagttcaacacatacaatgggatttcaacccatacaaccagttcagctaaggtgagctatctgtaacaggggatatagagctatcaataatataacccctgagccaaagactggtacagtgagcagtgggcaagcaagcaaagcttcatctgcatttatagccactccccttcactcccatgaccgcttgagatcccaaatagctgtggccttagaggtatgtatgagacaactcgaactctccatatgtttaggattgaagtcaaggcagaatatcctgagattgccataaaagcactgaaaagcctgcttccatttccagtatcctatctttgcgaaacatgagattatggagtaaactggacataagcaagcacactttggatgtcactgtctcccatcatccccagatgggaccatctagttgcaggaaaacaagcttagggctcccactgagtctgcattatggtgagtgggataattatttcattatatatcacaatgtaataataaaagaagtaagaattatcctgaaactgtatttccctctgtggaaaaactgtcttccatgaaactggtccctagtgccaaaaaggttggggactgctgatctacaatgaaaatacacaggaacgtaggcatctacataaaggaaactagagatgggtgttcttctccctgaagaatcagggatgcagggccattgcctcagaacaagtgcagaaagctcaccagctgatgcaatattctggggaagatctgttcttcatcagagaaggcagcaccatgcacacaagcctgtccacccaactttattaacacttagcatttctatttcctgtagccttttctctataaatatataattgtttccttcttttgcacactttacattataaaaaaatactttccccaagttgggcttccctggtagctcagctggtaaagaatcctctccaatgcaggagaccccggttcgattcctgttgggaagttccacaagagaagagataggttacccactccagtatcttgggattccctgggggctcaactggtgggttcaatccgtgggttgggaagatcccctggagaagggaatggctacccactccaatattctggcctggagaatttccttgcaaagagtcggacatgactgagcgactttcacttccccaagttattaaaaacctttcataaacacattgctggacttacttatatctttttagagtgaggcaaacattcctatatttacatattaaaaaatagaaaaacacttggactaaatattgagcaatcaagaaatagtaaatagtagtttgaaaagtttggctaaatgttaggatttttaagccaaaagctaaaacatgtttgagaaaagtctttaacctttcttcatttcagcttcagaaaggggagctaatcacagaaagttacaaaataaatatgattctgaatttcaatatttacattaaaattcaaattttaatgtatttaaagtagaagacacctctgtaaatttatatttataaaagtgataggtcatccttaaaacagtattaaaatgtcactttgcataaaaactgtgttaaaatacatttgttatttgattcagtgttttgctattatacagggagattactcaaaaaatattaaatgatttcaaaaaataaaatacaaaatatgtataattggtctctagcacactaaaatacaacaaaaaaggcaaaaattaattatgaggaataaaatttctaaactcaattattggcacaatttaaaacttttaactttatattaaataaactttgcaaaacatctttaaaaataggtatgtcatataattcttcctaacttcctggaggtttgaaaattttctaacacattataaaattaaagggggggaataggtaaatataaaaatgagcattgggatgagttaattcaaacgtgtactcattcacagaaaaagaaatcctcacaattacacaattccagtaattagcagaattctaacaaccaaaacagaatttagttaaggattagtgatcgaaagaccaaaatgagattatgagcatacagtatctatttttatacttaattaatgcccactctctcacaacatcttggaatcaccttatataaagaagcaaaatgggtgagaggacttgggagactggggttgtgcctatacactattgaactatgcataaaatagataactgatgagaatgtactggatagcacagggaactccacttaatgcgctgtgtgaaccgagtgggaatgaaggccaaacgggaggggatacatgtatgtgtatggctgattcattctgctgtacagtagaaactaacaggggcttccctcgtagctcaactggtaaagaatccacctgcaatgcaggagacctaggttcaatccctgggttgagaagatccactggaggaggaaatggcaacccactccactattcttgtctggagaatcccatgaacagaggagcctggtgggtggggttgcaaagaggagcctggtccatggggttgcaaagagtcgggacacgatgaagcatagcacagcaaagaaactaacagaacattgtaaagcaactacactccaataaaaattattctgttttagagcaagaaggaaaagtcccaataactagacaagcaaaacctacagaagaggcagagacttgaactaatgctgtgaacacatcactgaactatgttggttgctagattcctaaccagagaatacttggtctcaatatttaaagatataatcttaatataagagaaggtattttatgtacaatggaacatttataagcactattctttttgttgttatttttgttgtttagccactaagtgcagtccaaattctttgagactccatggactgtagcccaccaggctcctctgtccatgaaattttccaggcaagaatactggagtgggttgtcattccctcttccaggtaccttcccaagtcagggatcacactctcatctcctgcattggcaagaggattctttaccaaacactgagtcttatcaaatcactgagctttaccgaacactgagccaaagactgattctttaccaaaccagctgctgctgctaagtcactgcagtcgtgtccgactctgtgtgaccccacagacggcagcccaccaggctcccccgtccctgggattctccaggcaagaacactggagtgggttgccatttccttctccaatgcatgaaaagtgaaaagtgaaagtgaattgctcagttgtgtccgactcttagcgacccatggactgcaacctaccaggctcctccatccatgggattttccaggcaaagtactggagtggggtgccattgccttctccgaaccaggggagccttaaatttatagtattccaacagttctagattgcaggcaactactcatgctgccagagaaaggcaagctggctagaaggtatcagaagtcagagaggtaaggaaacaagagactattcttcttcatatttaaaataactttatcactggcctgcattttcacagatctattgtctacatgcagttcacagtgtccttttctaatattcaggctaatttatttgaagcagattttcgtggtactaaggcaataaactttacattcatttcttacaaaaatttatttttaaaattttgttgtaaagttgatcaaaaggtttagttttatgttaaaggacctacaggatagcaaggtacagaagaaaaatttttaatttctggaaatttggcatcagttaaacattgagaaagaaaggaaaagaaaactgtcaaaatgtgagacaaaaatgaaagtataagcaacaataaaataccttgtaaggtacaaaaatattttcaggaatacacaaaagtacataacatatcatgatatatctggtgtttgagagttgtgatggtctggtttcaggcgctgttctactcatattcaaccactaccatcaccgccactatcccaccccatcctactccctcattctagaataaaaatggaaaggaatcacaaaaattaaaattaaaacaaaaactacttcccccatatctcttacttttggaggccattacatctctaagaattcaaaattagaaaaccttaaaaaacgaaatctctattatttaaaaaaaaataaaagtctgcaatgaacagaaaacaactagaggagtttagacccctgcattttaagcaagccttacaccaaattccagtcctgtgaaaaacgagcaggagaagaacaaaaggcagaaagttgccctgtaagattacacataaaggcaagatgtacacaaaggtcttttgaaatacagagaaaaggtaccgaaagccacacaatacatggacaaaggaactgacaaatctcaaacatacagccaacctgatcaatgccgaattgtcatgtctgaagtcatggacctcaaatgcagcttctaaacgtgccactgtttgaagctgaacaagatggcatgtaagggatgtgcagcttgctcacgagtaagattttaaaactgcatgaagggtaaagaacccaataaaagagagaactgagttcaaagagacaatgtcaatgttctatctgaaaagctggagtgaatattcaagctgtcctctcaaaagagaacaggcatgcctcccaggtttccgttgttgggggaaggggtggtggccggggaacgaggtgagaaggggacgggtcaggagcggccagtggccagcaagcactgtcaggcccagctgtcagcacgtctctgggcaacacacactggcatttcagacgacgcgtccactcacccctgcttacgttccacaaagagaaatgccaagacatcttgcctatggagctcatggagcagatttttaaccttagttctcctaaatcacccttattttaatatttgcaataggagagaattcagcagggagcaataaaaccaaagcatagctacaaagttgaaaaatgagggacagaaaacaaaaagacagaataaaggcattcttgttttaagagagaaatggaaattaaccagcccctctctgaagcttattggcacctccagaccaccaaccagttgccaagtcacatctaagaagtaagtcattaacttacagcttgtctaacgcttctaagaaatcagattctagaacactcactaagctgcagataggataaccattcataaagcttcaataagtgagggactttatttcttccagaaggtcccattttcaagagggttattaaaaataaaacagttatcactggaaaaaaaaaaaaaaccaaaacagtatcattgaaaggcactaaaagctgaaaaagtaattcctggaagaaagcagattaccccaaatcaaacatcactaattttaagaatccatgagtggatatgtatatatacagctgattcacactattgcacagcagatactaacaaaacactgcaaagcaattatatacctattaaaaaataatttaaaacaacataaaattaaaaactatataagataccatcaaaaaaaaaatcgatgagtgggagaggggcatttcagactaaattttattttaaatataaatcttttggaattttaagattatctgccaattaatgagattatataaatttaacatattatcaactcactttccagtttcttcccaaataaaaataagggacaaaaaattgaaaatttcacaggtaactgtaaacagttatcacatgggggaaaaaaaagtaatgaactcggtaatgggaatgttgtcctctgtgttatgtggataaatctggtcactaaaaggagacgatctaaaacttttcttccaaataaaaaccgaattctcaacacactgcaaggcacaagcatattttaaaaagaaaatatttaataataaaataaccttccatgttatatcaccagaaatgatatcaccctgtcttaaatcaacacagtgtaccggttggctactctcacctttatcgctaaggtaaataagctataaacctctaaatacaagcagcaaccaagaagggtcttatcagttctgcttcaggaacagtgatcaaagcaaggcagagaaaagtcttagaggaagtctcagttttggaaaagaagtcaagaatctacccagaaagcaccaattgtgcaaaacagtgctgtaacactgaaaagagcaagaaagcagaaaggcctcctgcaagaattttaagactcattccacaaaaatagtgcaacagctgcaatcagataaattaaatatgagtttacagagcacagtaaaagaagaaatgaaacatacacatgctgcacaaaaaacaaccatgtgctagtattgataaactgctctacatttgaatatactcatcaaaatgaaatttgcctacatggaagccttgataggtaaagaacctacctgtcaatgcagcagactcaggttccatctctggggtcgagaagatcccctggagaaggaaatggcaacccactccagtattctcgctgggaaaccccatggacagaggagcttggtgggctgcagtccacggggtcgcagagtcagacatgactgagcaactgagcatgagcacaaagctttaataatgagcacacaatcgggaagccagcgagcatgtcacatcttcgacatcttcacagatgcagtgtgtgacagttaaaccaactatctctcctgatgccagcaagtggaaacctcaagggagatttgtttcaatctcttattagagtctgtgctaaggactggtaagtgtttacccaatcaggagataaaggaaatctatagggctacctattaataatctcatccatgcatagatgctggctgactcctgctacagctgaacattaatttaccaacaggtaaagaacacccatgaaattaaaagatgcttgctccttggaagaaaagctatgaccaaccaagacagcatattaaaaagcagagacatcactttgctgacaaagttccgtctagtcaaagctatggttttgtatgaatgtctgtctagtcaaagctagtcatgtatggatgtgagagttggactataaagaaagctgagcactgaagaattgatgttttaaactgtggtgttagagaagactcttgagagtcccttggactgcaaggagatccaaccagtccatcctaaaggaaatcagcctgaatattcattggaaggactgatgctgaagctccaatactttggccacctgatgcgaagaactgactcactggaaaagaccctgatgctgggaaagactgaaggcaggaggagaagacaaagacagaggatgagatggttggatggcatcactgactcgatggacatgagtttgagcaagttccaggaactggtgatggacagggaagcctggtgtgctgcagtccatggggtcacaaagagtcggacacaactgagcgactgatctgaactgacctgaaagaatgagggatgtccaaagaaaaagccttactgcaacatcaatgaaaagtgactgagtgccatgaatgaaagtaaaggacaatacagtcattaacaaaagccaactgtgccctggtaggtgacctaaaggacgtctgtgcaggacaagatttatgacacaaggaacttttagggctaaaaaactattcagtgacattagcatcactaaacactcagctgactgcagccaacagaaaaccagagtgtttcaagagacaacagatacatgattcaaatctttaatttcacttcacttgactgaattacactgaaatatattcatgcctgagaaaaaaagacaaaagctgaaaagaatcctggtcatcatttactaaggatttcacccaatttaagtggaagtggctagctgtaccattcaagtacagaaaagaaacttagaagtttctgttaaaaatcacaaatacactgtgctctggaataaaattgaaaaagaagaaaattccaaaaaaaaaaagaaaaaagaaaattccaagttttctcaatttcatactttctttaaaaaggttcaatttctcgtaatatgaaaaaccttagagaagccacttttattcttaaaatgcgaattctagttcagtttatccagaattacaatttaagcatgtttcaacatgtaaagttgactgcatttgatctaaatgttgtggaatccagtagagctgtttataattccaaataacattcaaaagattttgaaaagataactattgttactgaagggaagaaaagttaatttattcaatatgcagttcactgattaacattcatctgtgtggacattattaaactaacccttttatttcctctctgacaaagcttttcttatttcctttacaccccaacctttaaaatggaccttacaaagtttttgtcaaatggaaattttaattgagaatttgagccaacttaattaaggtcaatccagcgtggaaagttcaccacaaaagaatgaagtaaaacctcaaaataagcaagtttattattgcagatttccaatattaataactgtaacaactagagccccctctcccactgctggtgggaggatgaactgttatatctcctttggaaagcaatgtgacaataatgttccaagagtgaaaaaatgttctttacccatgtaaccaataattcaactcctgggaatgtgccctaagaaaataattaaaatgtccaaagctgtttactgtgaccacttgcggtccagtggttaagaatctgcctgccagtgcaggggacatgggtatgatccctggtctgggaagatccctcccaccatggagcaactaagcccgggtgccacagctactgggcccatgctctgcagcaagagcagccatcacagcaaggagagagcagttcccgcttgccgcaactagagaaagcctacatgcagcaactaagagctagggcagccaagaacagggaaacaaaatgtatgataaactgaaaaattatcttttatgttcagaacatctgaacattaatattgtctcccttctgtggttatatttcaataggtgagatccaggaatttgactgaaaaatgttattctgctgtgtacagaaaaatagaattgtatggtcactccatctatctggaattctaataaagctgctccctccttcttgccacctgagtatgttgctgcagtggaattcatggcccttacaacagcactggcagcagcaaagccaggagtgattctcaagagaggcagactttactaactgtcagagtaggttagcaaggattaactgagccgtcacaggcacagtccagttcagaaaaggatcaccagcttcaggctggctgtggatcttgtggagttatgtacactatttctaagctttagagtctttatctggaaaatacagataataacagtacctagtttattgacaaaaaaaaaaaaaaaaaaacgaggtggctgaaactggagcctattatacagagtgaagtaagccagaaggaaaaacaccaatacagtatactaacgcatatatatggaacttagaaagatggtaacaataaccctgtgtaccagacagcaaaagagacaccgatgtatagaacagtcttatggactctatgggagagggacagggtgggaagatttgggagaatggcattgaaacatgtaaaatatcatgtatgaaacgagatgccagtccaggttcgatgcaagatactggatgcttggggctagtgtactgggacgacccagagggagggtatggggagggaggagggaggagggttcaggatggggaacacatgtatacctgtggcggattcattttgatatttggcaaaactaatacaattatgtaaagtttaaaaataaaataaaatttaaaaaaaataataaaagtaattgatgaaagaaaaaaaaaaaaactcatcatgacaaagactctctccctgatgaaactttcatcaggctcctctgaccccgcttctggatgagggctcagccttggccctgccctgtcctttcttcctagcccagtttagcaagaatcctctagtccgtttaacagagcatccctacctttgatatctaattacatctgataactgatcaagttcctcaactccaacttttgatgtaccagtcctgggcttgccttttgcaacattcccattaggtcaatatagcaagaatcccccaacccatgaatgcctccttgtaataaatttccatccactgaccaccccttccaccgccgaccccccacccttcatcctgccccttggctatagatccccactcatctttgttgtactcagagttgagttacaattctctcctctgttgcaacagtcttcaataaagtcttccttacaattttaacaagtgtcagaataagcttttgtttaacaaggggaaatgagtgtgaatgtaaataaaatgcttggaacattaacttacgcacttctgttcagtcatgattctcacccagtaaatataaaagactaacttaatgtttaaacgctaaactgttcagcttaaatcaagtaatggctacttattacacaacggtttttactttttttggctgtgctgtgtggcataaggtatcttagttctccaaccaggggtcgaacccgtgccccctgcaatggaagtgcagagtcttaaccgctggacctccagagaagtcccacaaaactgttattatgataaagatccacagagagcaacatttaggtgctgcctcagagagctcaaatttagaacaggaacagagaatcactctaagcctgcgtcatacaacagtgcgcggcaggtcagggtacaaactcggcagagaagagaaactgatgaacggagtgtagtggaaaggtcaccagatgggctctgaaggaggaagacaagttgcagaatcactatcaaggtggaagatgaacactcaggaggaaggaaaccaccccaagggcaaaggggtaaaggtggagctgagactagactatgccccactggcaacacctgggcaagggagctaatgaaagatgtagcaggagcgggccaggatcagattcaccttttctaattaactttttccggtttgtgcccctctggcaactaagaagcgggatgggggaaatggcagttagaatccaaataaatgcatactatggaattggcaagaaaacatagacactgcccattaacaagaacaaaactgacaaggaaaaaaacaaaactgagcacagacacagtttgtagaaatacaccaaaggaaaaaagatacaaaattaatatgtcatcattaggtaaccttaaagattttatttatggtacagctattacaaactggtaactattaactactgaactattcttacaaaagaactgaatttatcccctgcagaactctacccacactccctctctgtcttcccttcatgacctggctaattcttcttgctattctaaactcaggccacatgtcctgtttgaaagttagaatggtttaagtggacttcctctattgttcttaaatgctctaagcttaggtctaaatccactgtaaactgtttgtttagtgtgtgttccttagacaagactttagtcccttgaaaacaagaacctgtttctgcatttctagccctgttacatggctctagccatgtaatgacatgaatgactcaccatgtatactgaatgaatgggtcttagaacaaatgaataaaggctgaaaactccatggggtcactcttccatcttcagtggtcacctgcataaattgagaactaaacaaggagtctttctgcagtcagattcctgatacattgtataatcctgcaactcttaggaatcaaactaatttcaattctccaaagtacctaaaggctgagtgctgaagactttatgcttttgaactgtggtgttggagaagactcttgagagtcccttggactgcaaggagatccaaccagtccatcctaaaggaaataaatcctgaatattcattggaaggactgatgctgaagctgaaactccaatacttcggccacctgatgcaaagaactgactcactggtaaagaccctgatgctgagaaagactgaaggcaggaggagaagggaaagacagaggatgagatggttggatggtatcaccagcccaatagacatgagtttgggcaaactccaggagagagtgaaggacaagggaagcctggtgtgctgcaatccatagggtcaccaagagtcggacaagacttagtgactcaacaacaacaacaaagcaaaaaccaaatactgatttcaaaagttccaaggaatacaaaatattccaagaaagacaacagaaatgaactagctccctaagtttcacagtgctatattagtcactctaattttcacatcaattatctggagttaagacagaaatacataaaacatattccaactaatgaagctgatgcttaaacatatgccttttcaagaaaaaactaaagcttcatagttttattgaaaacactgatgacttttcacttttttcttaatttaatattttaagagaggtgaagcagcttcttcttctttattaaataaaacaggcaaccatgctctagaaacttgctattttggaagcaacaatcaaaacgctcccaaggtttctctttatctgctcagagcacaagtttctcttagaaagtcttcattgattcggccctaaaatcaaataaattcagcttaacatcagaggcttcctccgcttattttatttactcagtaccaaagtacattgtcactgctttttaaggaccttttcaaagccaggcagttgtcacaggatgcagacaattcaagctgtaggacacaatgagggccactgacaactgccctgtctatacacttacgcctcctgagcaactcctctcacttgttctcaaaagttaattcatttccaaatgaaattaaaagacgcttgctccttggaagaaaagctatgaccaacctaaatagcatattaaaaagcacagaaattactttgccaacaaaggtccatctagtcaaggctatggtttttccagtggtcatgtatggatgtgagaattggactataaagaaaactgagcagcgaagaattgatgtttttgaactgtggtgttggagaagactcttgagagtcccttggactgcaaggagatccaaccagtccattctgaaggaaatcagccctgaatatttattcattggaaggactgacgctgaagctgaagctccaataatatggccacctgatgcgaagaactgactcattggaaaagaccctgatgctgggaaagattgaaggcaagagaagggaatataagaggatgagatggatggatggcattgccgactcaatggacatgagcttgagtaaactctgggagttggtgatggacaaggaggcctggtatgctgcagtccatggggtcactaagagtcagacaggtctgagggactgaactgaactgaaatgtaacagaaactaaccctttgagtaggtcaacataataatgtaacaaaggggaccaccctgtgggaaaaagaaacctccgggttccctgaagaaccactaccccaaatcctcagaccctcaagttctgtaaactagaatcatccaaacctaaatataccatggctcatctccttatgggaaaagctcacgcctacagaagcactgaggtgagactgaagaatcctttaagtagtaccaaagtttgaattcttcaaccaccccactccagcactcttgcctggaaaatcccatggatggaggagcctggtaggctgcagtccacggggtcgctaggagtcggacacgactgagcaacttccctttcacttttcactttcatgcattggagaaggaaatggcaacccactccagtgttcttgcctggagagtcccagggatgggggaacctagtgggtttccatctatggggtcgcacagagtcggacacgactgaagcgacttagcagcagcagctgcagcagcaactatgtacaaggttggacaaccattgttaggactcagagcaaatgaatcttctgtgaaatgcacatgacagtgaaaagtgcaagtcgctcagtgggtcccactctttgtgaccccagggactatacagtccatggaattctccaggccagaatactggagtgggtagcctttcccttctccaggggatcttcccaaccgacggatcgaacccaggtctcctgcattgcaggcggattctttaccaacacagctatcagggaagcacgtgaatttggtccaaacttttctcaagaatacaatccaaaccagagaaggagaatgatttcatccgtaagcacacagtaagtccagaaaaatggaggagtctagtgacatggcccttgtcacagatctgctctgttaatgcttgccacctaatgcaaaggactcattctgactttctgagacagcacaaagcttccctaaagtggttagcccagtagatcacccaccctgaagtgtaagacataaaatataaggttgggggaggggagaagacaaacatcgcattcaagacagccaggcagcaggcacactgattgagacccccccagtcccagacagtgagactggcactgcaaacagtaactctaccctgaaaggggagaagccagaggacacagaggcgagcacttggtgcgggtcaattgcctgaccattaactgagccatctatccacactcgccactgtgcactaaaaacaggacacaagatggcttttatagcatccccagctgctaaaaatgttaagaaaaccaatttcaaaacacgcagcagaacctgtacactgggaaaagaggaaaagcaacatgtgcatccagtgtcaaaaacacaaatcaagagaaaagagatgttcataaaacacctcacttttatatagctccgatttgtgaagcagctcaaatatttttgcaaattaaagaaaaaaatttaattataggacttctaacgacacccctgttaaataggtggaatgcaaatataattacttctgtttagctactgaagacaagtagacacatatttaatcacacgaaagtcagagtcctgatcgaactcagtccaggactttcagcatcccatacagccaagttaccagtaatttgagtgatcttaataaagtaaaatataaaagtgaaccccacggttttctatgctcaaaaactaaattctaagaattaacaattaagtcaaaattcgttttagttttagaaggaaaacagttcaagaattccatttaacctgttgaatctactttttaaaactttctttttcaggagtcaagaaaccattacgacaatgatgattaaagccacttaaatttagaaatcatagagaaaagtgaaaagtcagtttctcacactcaccaatataaacttaacagttttacgtctccttcaaaggacaaaaggaattcagtttaaagtgcaaggtcaaagtatagaaaaagacatgctggcctgggaaatcaataggtttaacaacaaaagatgagtcaaccaatacttgcagatctcagggtacttgaaagaatattttatgttgacccaggaaaggaattaaatcatcccactgatggctaggaaaagagatcacccttacgtgcctcatttgcgctttttaaaaagctattattatgaggtgcttttaaaagctagtatattattacagcattaaggggcacttcctaaatatatccagtatagctaactcctctccaagccaactcctggtgaaataattctttcttcccttcaatactgtttagataaggcacagacaaggcagtgcaggataactaaacctgaacttgctacaggaatttccaaacagataagaacttaagaacttagcaaatacctgccatttgaaagacaagagaaacttgaagaaagtatccagagaaaatatgagctcacaaggtaaactcttcaatgtagagtctgtctccttataaatcctattcagccctgagagactatgccagtgccaagaaagaaaatggcttccactgtcactatcaaaagcaatccactttaatgaaatgatatgacgtctagaatctttcaaataatctagagttgggctggcgggaaagatgaaacaactctgaccaagaattaacacttactgaagcctgataatgggggttagtggttggaatttttcataataaaaggtcaaacagagaaacagaagaaagctcgctttagaaagcaaatgcctctccactagcctatttgagtaaggccagcttatagaaatgcataactgagaactgaaaaggaacgtattatgtcaaaacttatttaaattctttgtggttataaaacaattaggatgacctgtggtttttctgttattcacacaggtatgagaggatgaattaagaaattacctgtttctacattactatgttttctcctttatgtcactgcagttaagcgtgattaaaaagaatgactgatctttttttctcttcattctagcaaaagatactctaaaatgaaggaaattgagataccctggggaaactgtttctacccccaatctagacttttaataaagcttagcaaatttcaaactaacctttacatcagtttctaagagttaagcttcaattaattaagctgatttttaatatattactttaatcttgacaaatattctcacaaattgtgttagcacatatttggaaattttcattcttttaaattctgctcaaaattgcaacacaaaagagaccaaaggcctgatgtcttagtcaacagaatcagtactctatgatgaatgccgtcaattccactttcgcctccagagttgatttcagacacttgacaaccaagattaatgtctgacctgtgagctgatcttacaatggacactttttatttttttttaaggagataaatgttagacaagtattcacatggaaactcaaaagttatcactgaagcccctttctttaagaagttatcagcactcttttcatactgaatttaccaggataccttaatagaactggaaaaattaaactctaggatgagaacccaagaatcacttgcagggcccacattcctctccagcgggtgtcacatggagcttcattctcctgctcttccctctttgttcctttggatctggaagcctgacttagaggcatctgcttcaacagcaaacattcagattatttaaactgccctctccacacattcctaacttatctggtggagcaggcatttcaaaactaaacagctgttaaaattaaaacagaaaaattcaccaaaattcaaaaactggtcactgacctcgctgaggctacatttggtatttcaaaatatttgcaaattacatcaagcacaggaagtctggaatcatgtcatctgtatggtaactttaacaggcctgatcagatccctttgtaaaacggacacaaactgtatctttcagttaatatataaggaatttggtccacacgtttcaagagacaaaccggtcctcagatctatactgagacagcaaatatttcatgcatgtacctcagcagggtggatcaccagcaatgtgaagggcctgatgactcaggactcagccatgtttccaaagcttagagggaagatgattaatgatactgaagaacaaggcatggtgaacttttacaatgggttgcttacaaaaagctcagttgctaactaagtgctttgaccttagataaagagggtactcaacacagaggttcaagcaggggctacattctggaatgactcacattaaacatatctagtatatttcaaaaagataacaggactcaaatcaacttattagcaagttttgacttttcaaaagattgtcaaaaccccaagctatgaaaaagtgattacatagtaaacgaagaaaaataaaagattaaaaaagaaaataaccctgatgccccaagaactgacaatctgatctttgaaccacctcccaccaaatttttcaggactctggtgtacttttcaccattcttctactcatttccgtgcttgcctcatgtgtgagagaaaaggaacaagatgtaactttattgaatgaatagttcatacggaggaaagcagaaaagggaaagctaaaattaattttatgactcctttatttagtctatgacccttccaattgttaattcatgatactatgtgttaaacaagagatacagcaaaaagtagaataagcgatcacaatatgactataaatatggacaatgttcaaacagcacatagagaaagaaaggaggaaaaggaaacagtgcaatatacaataaacatcatcagtcgtggtcctgagctgccagatagaagacagtcctttcctcagttgtatttaatataaattttgtataatggacatgtgggtgattaaaaagcaatttcttttatggtaaaaatgacccctgaagaatcatttttcatataataaataacaggcatagtttatgggagcttctctctataaaactgtttcaagcagctgcaaagggcagtaaagataatgaaaagtatggctttcctattattgttagaagtcattgtccactaatctaacaaatgtttactgagctgttatcatgtattaaatccagggtctgctgagatccccaaaatggtaattaagatagtcaatacacactatcaaggtgtttgaaaatacaggttgcaaaccttcctgccctacctccaaataaatatgcttcaaaaaaaaccctacgagacttccttgtaaagtgactacatccaaaaatatactgcaacagatagagtgatgatcaaaatatttgctgtccttcccttgccaaatccttccctagctgctcatccctggagcacattacatttcttggaccctgaggccacgtttgaccacatgacttgctttggccaatgaagaatgagttcaattcagttcacttcagtctctcagtcttgttggactcactctttgcgacaccctgcactgcagcacgccaagggcattaatatgagaaataaacttttgttgttggaaactctggggattgttactacaacataatttagccaaagttgactaattcatatattcctgactaagctctgatacattaaagacataccaatgggcaggaagaagaaataagtaacctatagtttccaacttaatctttcaagaagtagataaaatttggcccccaaccaggtaatcactactgtactgcttgttttgatttgttttcttccaaaagtctggaaaagccaatctgttgtacttcaagcatttgcagggacttgcctcatggtccagtggttaagaggtcacacttccaatgcaggcggcaagggttcgatccctggtaaaggaactaggatcccaaatgccacgtgatatggtcaagggaaaaaaagcacttgctttttgttgtcctctcattcaacattttagagatgtatgaaattcccttcctttaagaaaacactcaaaatgtgatacaatgaaaatactccacaagacacagagaacaagaaatgtccagaagaatgaaatctactacttttctttcaaacaaattaaatataagaatcattgctgtacacctggaactaacataatcttatatataggtcaattatatcttgatttaaaaacacttaactcaaaacatggtccactggagaagacaatggcaaaccacttcactattctttgagaaacctatgaacagtatggaaaggcaaaaacacctgacactgaaagatgaactccccaggtcggtagatgcccaataggctactggagaatatttaaccccagaaagaatgaagagatggagccaaagcaaacaaaacactcagttgtggatgtgactggtaggggaagtaaagtatgatgctataaagaacaatactatataggaacctggaatgttaagtccatgaatcaaagtaaattggaagtggtcaaacaggagatggtaagactgaacatcgacactttaggaatcagtgaagtaaaatggactggaataggtgaatttaattcagatgaccattacatctactactgtgagcaagaatcccttagaagaaatggagtagccatcatggtcaacaaaaaagtcagaaatgcaggacttgggtgcaatttcaaaaaaaaacagaataatctctgttcgtttccaaggcaaaccattcaatatcacagtaatccaagtctatgccccaaccactaatgctgaagaagctgaagttgaacagttctatgaagacatacaagaccttttagaactaacacccaaaaaagatgtccttttcattataggggactggaatgcaaaagtagcaagtcaagaaacacctggagtaacaggcaaatttggccttagaatacagaatgaagcagggcaaagactaatagagttttgtcaagaaaatgcactggtcataacaaacaccctcttccaacaacacaagagaagactctacacatggacatcaccagatggtcaacactgaaatcagactgattatattctttgcagccaaagatggagaagctctatacagtcaacaaaaacaagaccaggaactgactgtggctcagaccatgaactccttattgccaaattcagactgaaattgaagaaagtagggaaaaccactaaagcattcaggtatgacctaaatcaaatcccttatgattatacagtggaagtgagaaatagatttcagggactacatctgatagatagagtgcctgacgaactatggactgaggttcatgacactgtacaggagacagggatcaagaccatccccaagaaaaagaaatgcaaaaaggcaaaatggttgtctgaggaggccttacaaatagctgtgaaaagaagagaagctaaaggcaaaggagagaaggaaagatatacccatttcaatgcagagttccaaagaatagcaaggagaggtaagaaagacttcctcactgataaatgcaaacaaatagaggaaaacaatagaatgcaaaagactagacatctcttcaagaaaataagagatacaaagggaataatatttcatggaaagatgggcaaaataaggcacagaaatggtatgaacctaacagaagcagaagatattaagaagaggtggcacgaatacacagaagaactacacaaaaaagatcttcatgacccacataaccatgatggtgtgatcactcacccagagccagacatcctggagtgcaaagtcaaatgggccttaggaagcattctgccgtaagggtggcgtcatctgcacatctgaggttattgatatttctcctgggaatcttgattccagcttgtgcttgatccagtctagcatttctcatgatgtactctgcatttaagttaaataagcagggtgacaatatatagtcttgacatactccttttccaatttggaaccagtctgttgttccatgcccagttctaactgttgcttctagatctgcatacagagttttcaggaggcaggtcaggtggtctggtattcctatctctttcagaattttccacactttattgtgatccacacagtcaaaggctttggcatagtcagtaaaacagaaatagatgtttttctggaactctcttctttttcaatgattcaatggatgttggcaatttgatctctggttcctctcccttttctaaatccagcttgaaaatctggaagttcatggttcatgtactgttgaagcctggcatggagaattttgctagcctgtgagatgagtgcaatcgtacaataggttgagcattctttagcattgcctttctttgggactagaacgaaaactgatcttttccagtcctggggccactgctgagttttccaagttggttggcatattgagtgcagcactttcacagcatcatcttttaggatttgaaatagctcagctggaattccgtcacctccactagctttgtttgtagtgatgcttcctaagacccactggacttcacattccacgatgtctggctctaggtaagtgatcacaccatcgtgattatctgggtcatgaagatattttttgtatagttcttccgtatattcatgccacctcttcttaatatcttctgtttctgttaggtccatatcatttctgtcctttattctacccatctttgcatgaaatgttcccttggtatctattattttcttgaagagatctctagttttttccattctattgttttcctctgtttctttgcattgatcactgaggaagtctttcttatctcttcttgcaattctttggaactctgcattcaaatggatgtatctttccttttctccttggccttttgcttctcttcttttcacagctatttgtaaggcctcctcagacaaccattttgcctttttgcatttctttttcttggggatggtcttgatcacttcctgctgtacaatgttatgaacctcagtccatagttcttcaggcactctatcatatctaatccctttaatctacttgtcacttccactgtataatcataaaggatttgatttaggtcatacctgaatggtctagtggttttccctactgtcttcaatttaagtctgaatttggcaataaggagttcatgatctgagccacagtcagctcccagtcttgtgtctgctgactgtatagagcttctccattcttcacgagaacctaggggaaagaagcagtgactgattgagacctacctgctagtaggtctcctacagaggtatagtttggcagtggtttgctggaggacagaggcattggcagtagcagtgctgggacaagacccttgttttgagctctcttggaggtcaccattagccctgccatagagccagtagattccacggctgggtcacctcagccaaacaactaacagggagggagccacagccaatcagcagacaattggataaaagttttattgagcccttcccaccagcacagttcagttcagttcagtcgctcagtcgtgtccgactctttgcgaccccatgaatcacagcatgccaggcctccctgtccatcaccaactcccagagttcactcagactcacgtccatcgagtcagtgatgccatccagccatctcatcctctgtcatccccttctcctcctacattagagtcttttccaatgagtcaactcttcgcatgaggtggccaaagtactggagtttcagcttcagcatcattccttccaaagaaatcccagggctgatctccttcagaatggactggttggatctccttgcagtccaagggactctcaagagtcttctccaacaccacacttcaaaagcatcagttcttcggtgcttagccttcttcacagtccaactctcacatccatacatgaccacaggaaaaaccatagccttgactagatggacctttgttggcaaagtaatgtctctgcttttgaatatgctatctaggttggtcataactttccttccaaggagtaagcgtcttttaatttcatggctgcagtcaccatctgcagtgattttggagcccccaccagcacaataaccagtttttcctagctagcccctcccatcaggaaacttgcacaagcttcctagcttcatccaccagaggacagacagaagaagcaagaagaactaaaaccttgcagtctccagtacgaaaaaccaatcacagaaagttaattaaaatgaaaaggaagaggattacgtctcagatgaaggaacaagttcgttgtttaatcgttcagttgtgtccaactctttgtgaccccatggactgtagcccaccaggctcctctgtccatgggattctctaggcaagaatactagagtgggttgtcatttccttctccaagggatcttcccgactcaggaatcaaactcatgtcgtgcattggcaggtgggttctttaccacttaagctacctgaaaagcccaaggaacaagataaaagcccagaaaaacaactaagtgaagtggtgatacacacttccaaaaaaagaaataagaataatgataatgagaatgatccaggatctccgaaaaagaatggagaagatgcaagaaatgtttaacaaagacatggaataactaaacaacaacaacacaaaaaaacaaaaccaaccagaggtgaacaacagactagaaggaatcaacaacagaataacagaagcagaagaatggataagagacctgaaggatagaatggtggaaataactgctgcaaaacagaatatagaaacaaagaatgaaaagaaatgaagacagcctaagagatctctgggccaacattaaacgtaccaacatccactttataggggttccagaagggcaagagatagagaaaggacctgagaaaatatttgaagagatgatagctgaaaacttcccaaacatgggaaaggaaatagccaatcaagtccaggaagggcagagagtctaggcaggataaatcgaaggaggaacacatcaaaacatatagcaatcaaactgacaaaaattaaaggaaggataaaacactgaaagcaaccaggggaaaatcacaaacaacataagggaacttccataaggttatcaactgatttctcaacagaaactctacaagtcagaagggaatggcagaatatttaaactgatgaaaaaagaagaacctacaaccaggaatactctacccagcaagactcttaaccagatttgaaggagaaatcaaagctttgcagacaatccaaagttctgagaattcagtactttcaaaccagttttacagcaaaggctaaagagatttctctaggcaagaaacacaagagaaggaaaagacctacaaaaaataaacccaaaacataagaaaatggtaatagggtcatacatatcagtaattacctttaaatgtaaatggtttaagtgaaccaaacaaaagacagtctggctgggtggatacaaaaacaaaacctgtatgctgctgctgctgctaagtcgtttcagtcgtgtccgactctgtgccaccccatagacagcagcccaccaggctcccccgtccctgggattctccaggcaagaacactggagtgggctgccgtttccttctccaaaaacttgtatatatgctgtgtataagtgacccacttcagacctagggacacttacagactgaaagtaaggggatgggagaagatactccatacaaatggaaatcaaaagaaagctggaatagcaatacacataccagacaaaatttaaaaagagacaaagaaggacactacataataatcaaggattcaatccaagaagatataacaattatatacgcattcaacacagcacttcaatatgtaaggcaaatactaacacaacataaagggagaaattgacaataacacaataatagtgggggattttaacactccatttccatcaatggacagctcatcacacagaaaattaataaagaaacatagtttctttgtcatttaatccagctaaatgacactgtagaccagttggacttaattgatatatacagagcattccatcaaacagcagcagacaacacattcttctcaagtacacacagaacattcttcaggactgacaaaatgctaggccacaagccaagccttggtagatttaagaaagtcaacttcatatcaagcatcttttctgatcacaaaactaagagattacagataaataaactataagaaaaaaagctataaaaaacaaaaacatgtggtggctaatcaatacactactaaacaaccaatggatcactgcagaaataaaacaatacctacagacaaaagtgaaagcacaatggtacaaaatctatgggaaggagcaaaaactattctaagagggaagtttatagcaatacaagaacagtatggcagttccttaaaagactaaaaatggagctcccctgctatcttacttttgggcatatatccagagaaaaacatgatccaaaatgatacatgtaacccaatgttcactgtagcacagtttataataggcacaatatggaatgttgtccattgacagaggaatggaagaagaatggataaagcagatatggtacatatatacaatggaatgagcttctctggtggctcagacagtaaagaatccatctgccaatgcaacagacttaagagacacaggttcgatccctgggccaggaagatcccctggagaagacaatggcaacccactccagtattcttgattacagaattccagggacagaggagcctggtgggctacagtctgtggggtcacaaagagttggacacaactgagcaactaacacacacacacacacaaattactaagccattaaaaaagatgaaataatgccctttgcagcaacatagataaacttagagattgtcactgaatgaaataagtcagacagagaaagagaaatattgtatgacatctcttataagcgaaagtgttaatcatttagtcgtgtctgactctttgcaaccccatgggctatagtccattgtagcccacaaggctcctctgtccatgagatttcccgggcaagaatactggagtgggttgccattctcttcttcatgggatcttcccaacctatggatcaaacctaggtctcctgcactgcatgcagattctttatcacctgagccaccagggaagcccccttatattacatgtggaatcgaaaatgaaatgatacaaatgaacttacaaaacagaaagagactcacagacatagagaacgaactgatggttgctgaggggaagggagcttgggacggacatgtacacactgttatatttaaaatgaataacaaacaaagacctactgtttacagcacatgggactctgctcagtgttatgtggcagcctggatggtatgtgggggtgggggaaaatggatacatgtgtatgtatggctgacttccttcactattcacctgaaactatactctatactctaatacaaaataaaaaaaaattcctaaaagaaaggaagagttactgaatttaatacagtatcatttcaagaaaaaagctgtacatgataaaaaaataactttttattttcataaagtgtataatcaacaatgaaaacaacagtaataaaactttacacccccaatgctataacatgaaaacacatgaggcaaaaacaaaaggcaatctctttgaaattactggttaaaatgtggcaagcagtaacataaaacacaattgatatgagtttgtaattaacaagagtagacagaaactaaaatactgattttgtcacagaacaactgttacaaaatcaactgatatttagggagtagccaccttgtacagagtatacagtgaggagttaaacaggaagtccagaagtcataaactatacaaccatatagatatagatcaaggagaagatatgtttatatgtatgaataacacacctagaacataaatatttgcacagtaaagctgtacaaacgctttggcttgagattcaggaagcactcttttaaaagggtaaatataagattatacaatctcataatcatcttacttataggattaataacaatctttgctaaataaaaatttttttaatttatggtatgcaattcagtatgtaaaaaggtaccctcaagcaggaaatgtttaaaatcaagctgtactcatacctggccttcagcccaaaacatcaggaaccttatcaccaatatacttaggaagtgaatgcaacactgacagaaatgtcaaattaaaacctcctctttctttacgtcttcagagtgaagtccaatcttctaaggaaattatctttaaatttttgttaaccaagaaaacttattgtaaatgaagcttcacaccagctcgagattgaaaagctaggctgctctgattcaaatgtgagtacggaaaggccactagaccattcaagtatgacctaaatcaaatcctttacgattatacagtggaagtgacaaatacattcaagggattagatctgatagagtgcctgatgaactatggacagaggttcgtgacactgtataggaagcagggatcaagatcatccctaagaaaaagaaatgcaaaaaggcaaaatggttgtctgaagaggccttacaaatagctgagaaaaaaagagaagctaaaggcaaaggcgagaaggaaagatatacgcattcgaatgcagagttccaaagaatagcaaggagagatacgaaaacctccctcagtgaccaatgcaaagaaatacaggaaaataccagaatgggaaagactagagatctcttctgagagcaatggctgtgctttgctggagcagccatgaagagataccccacgcccaaggtaagagaaatccaagtaagacggtagctgttgcaagagggcatcagagggcaaacacactgaacccatactcacagaaaactagtcaatctaatcacactaggaccacagccttgtcgaactcaatgaaactaagccatgcccatggggcaacctaagacgggcaggtcatggtggagagatttgacagaatgtggtccactggagaagggaatggcaaaccacttcagtattcttgccttgagaaccccatgaacagtatgaaaaggcaaaatgataggatactgaaagagaaactccccaggtcagtaggtgcccaatatgctactggagatcagtggagaaataactccagaaagaatgaagggatggagccaaagcaaaaataatactcagctgtggatgtgactggtgatagaagcaaggtccgatgctataaagagcaatattgcataggaacctggaatgtcaggtccacgaatcaaggcaaattggaagtggtcaaacaagagatggcgagagtgaacgtcgactttctaggaatcagtgaactgaaatggactggaatggatgaatttaactcagatgaccattatatctactactgcgggcaggaatccctcagaagaaatggagtggccatcatggtcagcaaaagagtctgaaatgcagtacttggatgcaatctcaaaaacgacagaatgatctctgttcgtgtccaaggcaaaccattcaatatcacagtaacccaagtctatgccccaaccagtaacgctgaagaagctgaagttgaacgggtctatgaagacctacaagaccttttagaactaacactcaaaaaagatgttcttttcattataggggactggaatgcaaaagtaggaagtcaagaaacacctggagtaacaggcaaatttggccttggaatatggaataaagcagggcaaagactaatagagtcttgacaagaaaatgcactggtcataacaaacaccctcttccaacaacacaaaagaagactctacacatggacatcaccagatggtcaacaccgaaatcagattgattatattctttgcagccaaagatggagaagctctatacagtcagcaaaaacaagaccaggagctgactgtggctcagaccgtgaactccttattaccaaattcgacttaaattgaagaaagtagggaaaaccgctagaccattcaggtatgacctaaatcaaatcgcttatgattatacagtggaagtgagaaatagatttaagggcctagatctgatagagtgcctgatgaactatggaacgaggttcatgacattgtacaggagacagggatcaagaccattcccatagaaaagaaatgcaaaaaagcaaaatggctgtctggggagcccttacaaatagctgtgaaaagaagagaagcgaaaagcaaaggagaaaaggaaagatataaacatctgaatgcagagttccaaagaatagcaagaagagataagaaagccttcttctgcgatcaatgcaaagaaatagaggaaaacaacagaatgggaaagactagggatctcttcaagaaaatcagagataccaaaggaacatttcatgcaaagatgggctcgataaaggacagaaatggtatggacctaacagaagcagaagatattaagaagagatggcaagaatacacagaagaactgtacacaaaagatcttcatgacccagataatcacgatggtgtgatcactgacctagagccagacatcctggaatgtgaagtcaagtgggccttagaaagcatcactacaaacaaagctagtggaggtgatggaattccagttgagctattccaaatcctgaaagatgatgctgtgaaagtgctgcactcaatatgccagcaaatttggaaaactcagcagtggccatgggactggaaaaggtcagttttcattccaatcccaaagaaaggcaatgccaaagagtgctcaaactaccgtacaattgcactcatctcacacaccagtaaagtaatgctcaaaattcttcaagccaggcttcatcaatatgtgaactgtgaacttccagatgttcaagctggttttagaaaaggcagaggaaccagaaatcaaattgccaacatccgctggatcgtggaaaaagcaagagagttccagaaaaacatctatttctgctttattgactatgccaaagcctttgactgtgtagatcacaataaactgtggaaaattctgaaagagatgggaataccacaccacctgatctgcctcttgagaaatttgtatgcaggtcaggaagcaacagttagaactggacatggaacaatagactggttccaaataggaaaaagagttcatcaaggctgtatattgtcaccctgtttatttaacttatatgcagagtacatcatgagaaatgctggactggaagaagcacaagctggaatcaagattgccaggagaaatatcaataacctcagatatgcagatgacaccacccttatggcagaaagtgaagaggaactcaaaagcctcttgatgaaagtgaaagtggagagtgaaaaagttggcttaaagctcaacattcagaaaatgaagatcatggcatccggtcccaccacttcatgggaaatagatggggaaacagcggaaacagtgtcagactttatttttctgggctccaaaaacactacagatggtgactgcagccatgaaattaaaagacacttactccttggaaggaaagttatgaccaacctagatagcatattcaaaagcagagacattactttgccagcaaaggttcgtctagtcaaggctatggtttttcctgtggtcatgtatggatgtgagagttggactgtgaagaaggctgaacgccaaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggacgacagaggatgagatggctggatggcatcactgactcgatggacgggagtctcagtgaactccgggagttggtgatggacagggaggcctggcgtgctgcgattcatggggtcgcaaagagttggacacgagcgactgatcttatctgatctgagagatctcttcaagaaaatcagagatatcaagggaacatttcatgcaaagatgggcaggataaaggacagaaatggtatggacctaacagaagcagaagatattaagaagaggtggcaagaatacacagaagaactatacagaaaagatcttcatgatccagataaccacaatggtgtgattactcacgtacagccagacatcttggaatgggaagtcctgtgggccttaggaagcatcactacaaacaaagctagtggaggtgatggaattccagctgagctatttcaaatcctaaaaaatgatgctgtgaaagtgctgcactcaatatgtcagcaaatttggaaaattcagcagtggccacaggactggaaaaggtccgttttccttccaatctcaaagaaaggcaatgccaaagaatgttcaaactaccatacaattgcactcatctcacatgctagcaaagtaatgttcaaaattctcaaagctaggcttcaacagtacatgaactgtgaacttccagatgttcaagctggatttagaaaaggcagaggaaccagagatcaaattgccaatatccattggatcattgaaaaaacaagagtgccaaaaaaacatccacttctgctttattgactatgtcaaggcctttgactgtgtggatcacaataaagtgtggaaaattctgaaagagatgggaatcccaaaccacctgacctgcctcctgagaaatctgtatgcaggttaagaagcaacagttagaactggacatggaacaacagactggttccaaattggaaaaggagtatgtcaaggctgtatattgtcaccctgcttatttaacttatatgcagagtacatcatgagaaacactggactggaagaagcacaagctggaatcaagatttacaggagaaatatgaataacctcagatatgcaaatgacaccacctttatggcagaaagtgaagaacaactcaagagcccctttatggaagtgaaagaggagaatgaaaaagttggcttaaaactcaacattcagaaaacaaagatcatggcatccagtcccatcacttcatggcaaatagatggggaaacaatggaaatagtgagagactttattttggggggcttcaaaatttcactgcagccatgaaattaaaagatgcttgctccttagaagaaaagctatgaccaacctagacagcatattaaaaagcagagacgttattttgtcaacaaaggtccatctagttaaagctatggtttttccagtagtcatgtatggatgtgagagttggactataaagaaagctgagtgcagaagaactgatgcttttgaactgtggttttagagaagacacttgagagtcccttggactacaaggagatcaaaccagtttgttctaaaggaaatcagtcctgaatattcattggaaagactgatgcggatgctgaaatttcaatactttggccaggaggagaaggggacaacagaggatgagatgtttggatggcatcattgacttgatggacacgagtctgagcaaactctgggagttggtgatggacaaggaagcctggtgtgctgcagtccatagaatcacaaagagttggacccaactgagcaactgaaccaactgactgaaggaaagaacacaggctgggagtggattcacaaatggctacatcccaccaggaaggagcaccatgagccaggccctgggccaagcaaaggcattggaaacaaaacagagtctctgaccccagagagcttacaccttagaatggggagaagctaataaggaaaataaaaaatacgaccgtttcacacatacagaaccactaagaaaatgaggtaggggaacaaggcagatgatgcctggaggtggtatgtgggatttctttgtgtgcttgggtagtcaagggggacctctcttaaaagaacaggggtcgcttctgagacggttaagtcagtgcaaagatctgtggaaggaaaagaacttatccaaggaagagaaagaggccagtccagctggagcaaagggaaccaaaggagtgtagaaacagaggaaattggaaaggcaacggaggccagaatacaagcctctcctcaagcgaggcttggatttaagtgtaatgggaaggctttgaaaggctttgagcaagggaacaacttgacccgatttacagtgcagaagctgccgtgtggaacagattccacgcaggcagaatggaatcaagaaaactagcgaggagaccatggcagatattcatctgagatacagcagtggccaggagtaacattttaacagtggaaacaagagggatatattttaaacagaaagcccacagaaattaacaatggaatagatatatactgtacacagaagacagaggaatcaaggagagctgtgatgtttctgggtgtataatggggtggatgagggcaccatttacaagacagaaaggtctagagtgtacagattagactggggacagcatcaagaattctgtttttacagatggtcagtaggcacataaaagatgctcaacatttctatttattaaagaaatgcaaatcaaaaccacagtaaggtaccacctcacaccaatcagaatggccctcatttaaaagtctacaaatgaccaaaatggagaggctatggagaaaagggaaccctcctacagtgttggtaagaatgttacttggtgcagctgctatgcaaaacagtatggaggttccttaaaaaactaaaaacagagctaccatatatccagcaatcccactcctaggcatttatccagagaaaaagatacttgtaccccagtgctcacaacaacactgtttacaatagccaagacacagaaacaacttaaacacccatcagcagaagaatgaaaatgtggtacctttatgcaatggactctcactcagccataagaaggaaggaaatgccgatttgcaacaacatgggtgcaactagagactatcatagcagtgaagccaggaagacaaataccgtatgatattgtttacacgtagaatttaaaatatgacacaagaacttctctacaaaacagaaacagactcacagacatacagaacagacttgtggttgccaggggatggggggagggaaggacagattgggggtttgggattagcagatgcaaactatcatatatgtgtgaattgaatcactgtgctgcacacccgaaactaacacgacactgtaaaccagctatgtctcaataaaatgaatcaaaaacaaaaaagaattgttttgatcacgttaattttaaagagcctgtaattaggtgcccaagatctgcccaataggtgcctcactggccactgaagtctatatattcttgggagaagttggagctggaaatatccacatatctctcatacctctattcccatggcaaacccttcaagtcttctctgaaatcccaatgccccacagagcagtgtgaaaactcaatgcttacctccaactggctaaactaaatttgcctaattttgcatagtgtggccgaaaaattaaatgaggaaaacgtaaaatgcatttacccacactagaatttgttgacaacaaaacaaattacagataggttaaagattctagtgggaaaaaaaagaaaccatgaaagaatgcaagaagaaaatacaggttaatatttataaaatctaagtgagagagggcttccttacttgaccaagggcagaaattcttaaaagaggaaaataatggtggattgaggggagggaggtttaaatacttctagaaaagaaaatatcacaaatcttaaaagcaaataaaaaattgggaataaggaaatatccttacatatttatataaggagctcacacaaattaagaaaaaatcattaactccaaaaagaaaacatgacaaggaaaagagaaaattcaaaagagaagaaatataagtgaacaattaacacatggaaaaaaagtgctaaacttcttatcagtagaaggaattaaaataaggagacagtatttgtcacctatcaagctcataaatatgaaaatggcaatgagtgtagacttggagtctggacagtaattactaaactctttgtgatgacaatttggtaacgtatcaagtgaagtgaagtgaagtcgctcagtcgtgtccaactgtttgcaaccccacggactgtagcctaccaggctcctctgtttatggaattttccaggcaagaatactggcatgggttgccatttccttctctaggcgatcttcccaacccagggatcaaacctgggtttcctgcattgcaggcagatgctttaccatctgagtcaccagggatgtcttagattttacatgctctttgacctaccaattccacttcagggaattcatccaaaaggcaggggtattggagggttgatgggaaagatttaggcacaaattattatttataagatgcttcagaatcacatctaatgacatgaaaagatattgtaccttaaaataagggtttttaaatcataaggtcagaataatacaaagcaataagaatattcatataaagagatcactaacaataaattataggaaatcaacactggttgtgtctagaaaaaataaccgctctttacgatctttttctttcattacaatgagcatatagcatttaaaaataaaaacttcgtttggggggaaaacaaaactaaaaatcctttgcataaaagataaattgaataaaaattagcaaaaatttaataggagatcatttcaagtgatagaatataattggggaaatttttcatcctttctagaatagaaaattctctgtatttacatatgttccattataaatatgcactattattttttttttaaagtaaaagaaacttaaagatggttttccaattttttgttatctgaagttgaatgaccgttacaatgatctcactgtgttttaaagggtttatgccctgttcttcatggaccaaacccagtttttctttataattccaactagcttagagggcacaaaggggttctcctgaaatatgaaatatactgcatctcatacctcctttccatttactacctttagtggacttcaatgcttcagctccatggctgtcaaagtctggtcctagacctgcagccccagcataaacagggagctggtaaatgcagattcttaggcccacatcagacctagagaatacgaaatagggcagggggcttccctggtggctcagtggtaaagaatctgcctgccagtgcaggaggcacggatccaatccctggtccaggaagatcccacgtaccacggagccacaaacccctgagcctgggctctagagcccacctactgcaactactgaagcccacactctagagcccttgagccacaaccagagaagccaccacaatgagaagcccatgctctgaaatgaagacacagcacagccataaataaataaattaaatttaaaaaaaaccaacaggctaggactcaacagtgtgctttatcaagatctccagctgactctgatgcgtgcttgaattggagaatcactgtgtcagcccacagagctttgcaccttcagtacgcagaaactgtcttgtgtgtgttgcatgctcggtggctcagttgtctccgactctctgacctcacagactgtagcccaccaggctcctctctatccacggaagcatctatgcaagagtactggagtgggttgccatttcctcctccaggagatcttcccaacccagggattgaacctgagtctcctgcattggcaggctgattctttaccacatgggaagccctccagaaactctcccaaacacagtcaaatcatttttcaaatttatatctttcagaatcctaatggtaacacattaaatcattcaagaggactgagctgctagatctcgaatcttaacagctggaaacaacatttaagaaaaataaaaagataacaaggaaagaaaaccatacctgtagaaatgccttaaagggagcagtgagtcctagagacatcacttcaagccttcgacagcctttgaggtaaacacactaggcctccttaaggaacacactaaattcaaactcatttaattacatgtgtcagtcagggcctcacaatcaaacaatcaaccagactcctgcgtaataacaacactgaagccatacctagacataaatacaataatcaggtgtgccaaaaatatgtgaaacattgttacttgaattgactgatgagcccacctggagcaagatctactggcgtttgaaatgaacaactattaatatagttgcttatctgtgatggaggtataatcatgatagaaatgagacaaagtctaaccatagcccaaggaagtatcaagttttctgccacattcatcacttcagagagtcaggtactgagccagtgccagagacaaaatagtgtctaaaatatccctcctgcccgccagaggcctgcagtccacttggagattggtaaacaccagactgcgacctccactcaccctgggacagaaacgtcacatgccttatctctaatactcgtgcttaagtcacttggtcaaggccacccaactccctacaagtccatgctctgttctcgcctctccattcacgtgtaacgtcagcaccaaagggatatgagtatgtatgcactattgcacactacatgagactgtgctaagaacagacctttccaggtggcgctagtggtaaagaacccacctgccaatgcaggagacgtgagagacagaagccgcaagagacaggagacatgggttcaatccctgagtcaggacgatcccctggagggagggcatggcaacccactccagtattcttgcctgggaggtggggtcacaaagagttggacacgactgaagtaacttagcatgcacatgctaagaataaagccaagaataaaaatgattttgttgctactaaaaaagagacatcgagttcagtaaaatcaagtagtgtcaagccaagtaaaacagtttataaatggtactggttttgaataggaaaaattacccatagaagaaccaccaagggcaaggccaatatggatcaaaatatcaacactaattatattgaatgcagagattataggcaattattggctcaatttgaaattcttttataacacaaattgtttttaaaaatgatcatccaacattaaaataaaatgctttttttttttaacccagccaagattccattaatcagcagttctcaataagtatgttccactcctcaggagatgttcagaaatacgtgggggtatttttggttgtcacattcactgggaggcaccactggcatttaacaggctactcagaacagtctcatacaagtaaccatcccaagcgacttgaatgtctgtctagacattcctgtagggggaaaaacccatttataagtatctgggcctagaaccaaactccattttacacattaatacaaaagacattttgcaagtttttacttgcaaatgtcctggggtcctagtagtgtaaaatactttgatttcttctttagaaaaagttgggcagtacattgagatttgaaagtatgtatatgttattgataaacttaacttgatgaaaagaaacttgttgtttaggcactaagtcgtgtccaactctttgcgacccatggactatagccttccaggctcccctgtccatgggattgcctaggcaagaatactggaatgagttgccattcccctctccaggagatgttcctgacccagggatcgaactcctgtctcctgctttgcaggcagattctctagcactgagtcacttggggagaataaaggaagcattacaaaaagggaatgctgggtctgacaaggttgagagtttgctgtgatgacccagggaatatgtacgcagtgaggagaatccagctgacttctattaagccagacatagaagagatccacaaaaaatgcagaacaaggccatccttctcactacaactctttgttgtgaaaaatagggttattctcattagttatttatgctaacttggaatgatttgagttttaaatgaataaaagtgttaaaaataagtaaattttcagtttcactcttactatgggaacatcaataaagagaacaaccataagcaaaagctctttgatagccttcggtacattttatgtgcatggagggatttaagatgaaaatgtttgaaaactgttgcacttatagaaaaagataaggaagaagggcttagctggctggagagaccaggtcacagaccagagcagtggctgggtagagtggggaaacttggagaaccaaaccagatcaacagggctggattacaagcagtgaaagaagagggagggattccggatgaggcagaagccttgcttcaggcagctgagtatacacagcccaaagagattttaacatcataatcataaacatttgtgtgtcataaaaacaatttttcaggagaaagtaaacccacaaacgtaaaaaaaaaaaaacagcacaaacagcccttttccatgcatatgcaataatagtagaaaataccttcttctctccctgcttctgatacgtgtaaacaaaccagaatgtttggactctagtcacgaatctgactgagcccaaccctgggtatcaagggtggacctgggcagtgtccgcccccctccctcccccggggcagcatctccccaccaccacccccgccagacctccttcagccagcatcttcaaggagtccacccactatttctttaaggattcagtttcaagagccttttaaagcagagatgttcaaagaagcaggaaggcgggaccacctgcggccccatggcaggcttctgcaggaactcctgggcaggctgagcctctcacggccccccaaggactgtgctgtccctctcagggctcaggactgagaacggatatggccacgcagcaaagaaagtcccttaaggaaatgtccaatcacgcccaatttttaacactcatggagccttcccgtcacatgaattgcctggaagatcctcgggccccaccctacttcccacatcaccccattgtggacgtcggacctagacagggatctcgggcaacaggactaagagtagggaagagaaaatggaaggaggtgggaggacacacccttgagtcccccgggaaatctcttggccacattcccctcctagcctggggcaggaggcctggattattctgcctcttccagccccagtgatgacaagcctggaggagccccagcaaggtaggtgacattctcagaggccaagggcttttattttatttgaatcccaaggacccctaccaccactcatagctataccgcctatttccaagtttctttttcaaaggttttcctagggattccctggtggctcagacagtaaagcatctgcctgcaatgcaggagacctgggctcaatccctgggttgggaagatcccctggagaaggaaatgcaatccattccagtactcttgcctggaaaatcccatggatggaggagcctggtaggctacaggacatgtggtcaacaaagagtcggacacgactgagcgacttcactttcactaaggacccctaccaccaccaacagctataccacctatttccaagtttctttttcaaaggttatctttaacaccctcccccaccacaatcctttctctcatttctagctggtagtaaaaaatctcagaataattcaaatggagtaaatgtgggactccatgacagagattaggagaaaactgtgaaaaatctaagttagtccaaagaactgcagaaaaggggagagatgcccctgtaagccacatgctgaggcaatccctaggaaggaaacatccagctagaaaactggaccggggcatttaggggagaacggatatatgcatacatatggctgagtcccttcgctgttcacctgaaaccatcacaacactgtcaattggttacatcccaatataaaacaaaaagttaaaaaaaaacaaaactggaccagaggcatcctggggcaaggagtctggccccctatagctccccatcctcctatccttgctccccacatctttgctggagcctctgccgaggcttccccccagccctactaccgccctcatacagcactactataagggggaagtgtgggcaggccttccaagtgggaactgtttatgtatattcccagagagctattattatacagtatgcacacacagacgtagtatacagtgctaacagtgcagattttggagtcagactgcacaggtcctaatacaagatcagccacttaccagttgtgggatcataggtaagttacttcaccattataactactttctctgcagaaagtggagaggatgagatgagttttcacatggggaaacacctagaacactgccaacacatagcaggcactcagtaacatcagctgtgatgacgcttcaagcactttgtgtgttccagaagtttgggggaactgattatagtaatgttaaccaacatatctagtatcattcctattgtaaaatgcattcaaatttaaaaaccatagacttaaccaataatcgagacgcttttcctaaactggagacttaaaagtgtcccgaaagaaaatcctagttccagatctaataacctccgagcaataaggaggtaaaacaaccaccaccaccaaaaaaaaaaaaaaaaaaatcatctagcttacaactattttccctctattttcaaaaatgtataacacaggcacctcatatgatttttttttattagtagtatgtaacatttttgctaagatactgattcaccaacattctggcctcaggactctttttacttttccttttttttttttaagattttttggtcactccacacagcatgtgcctgaccagggatcaaacctgtgcccctgcattagaagggcagagtattaaccactgggccaccacttaaaaaattgaggaaacaaagagctcgccttagaaaatctaagaaataaacattatttaagcatataaaccattagccattaaaggaatgatgccatcaagtgcatatagctactggaaaactacactgaacacatgaagaatgagagtaaaaaagggaaatcgaaacttaattatcattacaaaaataatctgaacttgcagaccctctgaaagggtctcaaggatccccagagcatccagactccactttgagaagccctacactaaggaagaaacaagtatcaaaattctcatcgcttccattttctaccttttctagctgtacaagagaataattatggtacatttcactgaactatatatgaaatgaaaatgatcacatcctaaaatcaccaaaaaatcattcaatattctgacaaaattgccactaggtaaactaaactgctattttttcccttttttaaaaacagaaaacttaccatttaaatcatcttaaaatggacaattcactgacatgtaacacattcacaacgttgtgcaccaacacttggttctagaacattcatcatctccgaaaggaaccccgcatccagcccctagcaacaatcaacactaacctctttcagtacatctgctaatcctgagaatttcatacaaatgggtcttacggtacacgcatggccttgtctggcttctttcacttggcgtgttttcaaggttcatccatttgtagcaggcaccattcactctgccttatagctgaataatattcattataagaatacaccacactgtgtttgtccactgacagacaaaagttgatggacgtgagtatttccaccttttgactgctgttaatagtgctgttataaaaatttcaggtacgttttagtgtaaacacctgttttcagttctttggttctcttcataccctggaatggaattgctgggccatgtgactgtgtatttcgctcaccgaggaagagcagtagcacaattttacatgcctactagcaattccaagttttttgcatccttgacaaaggtctgttttctgttactgttgctttgtaacagccattctaacgagagtgaagcggcatctcatgctttagattcccatttcctctaaacacactgaacatttcctcatgtgcttgttcggcatctttgcagaaatgcctaggcacatctcttgcccattttttaaattgggatatttctttttcttttaggattttaagagttcttattttttttgtcagtagatgaaagcactttaaacctaccgggcttaagaggtcctttcctctctaccaggcttaagacaaatgccaactttccagatggtgaaagagcaactaagaagttacaagaggtcgcagaaccaattgtcgataatactatataatgcctccatttacgtcttaaaatgggagtccaggattgggtcacagatgatgataaaataatagtcatttttcaaaaagcactttttagtgagacaccatcccaagtactttaacaccctcacagcaaccccacaaggtaagaaccgtgacctacctcattttataaatgaggaaataggtacagaaaagttaaatagctggcttatggtcacacaatcagtagctggggcaggctgccttcagaatttgtgctcttaatccctttgctatactgcctctcaaccatgaaataacacgccttgcctggatgcctaactgaagacttttttagaagctgctagtagctacatttttgatctgtcactttcaagttctaacctccactgcctgcacaaatcttggctccagaattctttaactgagtttagggaatgtcacaaagaaagaagccgaaagccagaggggtgaatgtcattttatcattccaatttagatcttttctaagattttttaatccaacaaagcctattcataggataaatgtgccaacagactatttctaagagcatgtggccagcatcttgactgcgattatcagaggtttcagttactacaaagccagggctgaaaggtccatctaactcaaacccataatttgcagtataattatatagcagtaaatgggtttgtaaactgaatctcaaacttgaaatctaaaaggtaatatgtttcataataaaatcaatatgaacacaatgccagagttaacagatttcattttttgagcaataattacaggcatcactgactgatacttccagcattgctgcaactgcctggagttatgggacctcagaatttgaaggaactttatggcatatctaaaataatccatcacgaacaattcctgtttcctctagaattaaaagctggactaaagccctgaagtgtgcctatctgataaatggttcatgtcataatgttactctcctatttatgtctgtggtaactcaagaattttttaagttcagctacccaatacgccatttgtaaatattttcatgactacaaagggtagtaaatgtgaggttctgttttctcatctgcaacataggtatttaccatctatttaccactcatctcactgaagggcttcccctgtggctcagctggtaaagaatccacctgcaatgcaggagacctaggtttgatccctgggttgggaagatcccctggagaatggaaaggctacccactccagtattctggcctgaagaattccatggactgtatagtccatgcggttgcaaagagtaggacacgaccaagtgacttgcacttcacttcactttttcacagtatggtgggaaacagattttagatgggatatgtgaaagtgcctagcaaaatcccagagcaagaacaggtgctcagtaaacattcctttgtgtgtgtgtgtgtgtgcacgcacatgcatgcatgggaggggcggcagtgagttaatgggtgtgtgcatgggggatggggtggggatgggtctgggtcagatcaccagaagtcttccaaagcatactgacatactttacataagctaagcacaactcagataacttatctaaagatcacttatctgatgaacttagctgtggttcagttagttcagttcagtcgctaagttgtgttcccaaggaccgcagcacgccaggcttccctgtccttcaccatttccctgagcttgctcaaattcgtatcaactgagttggtgatgccatccaaccatctcatcctctgtcatccccttctcctcctgaacttagctgtatataaccccaaatctgctgctgctgctgctaagtcgcttcagtcgtgtctgactctgtgcgaccccatagacggcagcccaccaggctcccccgtccctgggattctccaggcaagaacactggagtgggctgccatttccttctccaatgcatgaaagtgaagttgcgcagtcatgtccgactctttgcaaccccatggactgcagcctaccaggctcctctgtccatgggattttccaggcaagagtactggaatggggtgccattgccttctccgaaccccaaatctagatgatggcaaaagatcttaccatttaataatgaggaaaatgctgatcatttgtgtagttattaaaggaaatcagattattcttcaggcaggccagtctataccatttctgatagagccgaagacactaaagaaatagctcatcacctggttactcaaatatttctctgaattagggctaggaaggttcaacatgcaaaacagcaagtatctgaacaaagcttaaatcacaagagggatgttttcttgttatgatggcattgtgaagaactgtaaatccaaggcatccctggtgggtcagtggtaaagaatgcagggcacacgggttcgatttctgatccaggaggatcccacatgctgctggcagccccggggccacagctactgagcctgtgctctagagcatgtgctccacaagagaagctaccgcaacgagaagtcaacgcaccacagctagagagtaaccccgaccgcagcaactagagaaagcctacgcgcagcaactcagcacagcccaagataaattttaaaaatagcctacatgaaaaaaaagtcttaaaaaaaattgtaaatcgagggatctaggaaatagatggagatagtcaaaagctgggaagtggggtgggaatcagaaggaagatgactaatagctggggtaggaccttctacttcagggagacccagcaagcccagaaggatatcacccagagtgagggaggcagaagcaaaggaacattctgggttgggggaaatggagtgtcaaggcaagtgcctgtgacaaaaggaccactttgtgagatgcaggtggccggagtcagggaaggtgaggtacagctggagaaaaggaaaaatcaggaaaatcagcagggacagagcacagagcgctctttagaccatgcataaaggttcagacttcatcctgtgaggtagcaattggtgtggtctggggagtccctggagttcccaagcccctgtgagggattcaggtcgagatcatcatagcactcagacatcactttcccttttcaccgtatttacgtgcactgatactgacgacagccacctcaacagaggcaccgaactgaactaccggtcactgtattctttacccccacgcactcacatttatttttttttaatttaattttatttttaaactttacaatattgtattagttttgccaaatatcaaaatgaatccgccacaggtatacatgtgttccccatcctgaaccctcctccctcctccctccccataccatccctctgggtcctcccagtgcactagccccaggcatccagtatcgagcatcgaacctggactggcgactcgtttcatacatgatattatacatgtttcaatgccattctcccaaatcttcccaccctctccctctgcaacagagtccataagactgttctatacatcagtgtctcttttgctgtctcgtacacagggttattgttagcatctttctaaatcccatatatatgcgttagtatactgtattgatgtttttccttctggcttacttcactctgtataataggctccagtttcatccacctcattagaactgattcaaatgtattctttttaacggctgagtaatactccattgtgtatatgtaccacagctttcttatccattcatctgctgatggacatctaggttgcttccatgtcctggctattataaacagtgctgcgatgaacattggggtacacgtgtctctttcccttctggtttcctcagtgtgtatgcccagcagtgggattgctggatcataaggcagttctatttccagatttttaaggaatctccacactgttctccatagtggctgtactagtttgcattcccaccaacagtgttagagggttcccttttctccacaccctctccagcatttattgcttgtagacgtttagatcgcagccattctaactggcatgaaatggtacctcatagtggttttgatttgcatttctctgataatgacgcactcacatttaaataaactaattttcaaaaaaatttaaagacaatttcaagtcagaatatccctgatgagttattaaaaacattatattaaacgttgatcctcgagtacatgtgtttaataccagtctgaataaaggggaggcgtcataaagcatttcttttatttctgtaacttgtggaatgttaagcttcccgactacttaaggaccgaaccactgcccttggcagtgaaagcagagtccttacccttggatcgccagggaatgcccatgaagcgcttctatggcgcaccaagaaacacacttatgcaaatgagttacaaggtgaactagccgctgtttttcatggatcacaatgtttacttagcagaatgacaacataaaaactacggttattcacacttgagtacttggcagacagtttctcaaaaacgagagctctacagatgactcagtggtaaagaatcctcctgccaatgcaggagatactggttggatccctgggttgggaagatcacctggagaaggaaatggcaacccaccagtattcttgcctgggaaattctatggatagaggagcctggagggctacagtccacagggtcgcaagagtcagacaagactgagcacgtcctgtgatcgtgtgttctcaaaatgaagtgggcctgctgcttcaagaaaaatgactggcagtatttgatgctgtagataaaagttaagctttgcataaacatttaaaacttggaaaacaagtatctgccattgtgagctttccccaaatttagagaattttctaataagatgggcagtatttctgctttattgactatgccaaagcctgtgactatgtggatcacaataaactggaaaattctgaaagacatgggaataccacaccacctgatctgcctcttgagaaatttgtatgcaggtcaggaagcaacagttagaactggacatggaacaacagactggttccaaataggaaaaggagttcgtcaaggctgtatattgtcaccctgcttatctaacttctatgcagagtacatcatgagaaacgctgggctggaagaagcacaagctggaatcaagattgccaggagaaatatcaataacctcagatatgcaaatgacaccacccttatggcagaaagtgaagaggaactcaaaagcttcttgatgaaggtgaaagagaagagtgaaaaagttggcttaaagctcaacattcagaaaacgaagatcatggcatcaggtcccatcacttcatgggaaatagatggggaaacagtggaaacagtgtcagactttatttttgggggctccaaaatcactgcagatggtgactgcagtcatgaaatcaaaagacgcttactccttggaagaaaagttatgaccaacctagacagcatattgaaaagcacagacattactttgccaacaaagctccgtctagtcaaggttgtggtttttccagtggtcatgtatggatgtgagagttggactgtgaagaaagctgagcaccgaagaattgatgcttttgaactgtggtgttggagaagactcttgagagtcccttggactgcaaggagatctaaccagtccattctgaaggagatcagccctgggatttctttggaaagaatgatgctaaagctgaaactccagtactttggccacctcaagcgaagagttgactcattggaaaagactctgatgctgggagggattgggggcaggaggagaaggggacgacagaggatgagatggctggatggcatcactgactcgatggacatgggtctcagtgaactccgggagttggtgatggacagggaggcctggcacgctgcgattcatggggtcgcaaagagtcggacatgactgatcgactgatctgaactgactgaaagttaacaaatgggttttcgttatattggttaatgaaacatttggaatatccatattactcagtaaagcagtattttccaaatgaccaacacatgatggtacaaaatcacaaaggaggaaaatatccattcaaattgcaagatagatgaacagattttattgtaacaaaatatgaagtttactaacataacttcagattccacacaaccactaacccttaaaaaaccactattgctaaattttggtatagtatcaaagaataaccacagttttctggaagtgatattaaaagactcctgctttctccaactgtgttatctatgttaagaccagacttttgtcaactacttcaatcaaaacaacatttcacaatattccactactgagcagatatgagaagccagctgtcttctattaagtgaaacattaaagagattttttacgttaagtgtacaatggatttatgacagatattttcagtaaataaattagtacttttaacattctcagttttaatcactaacctgacaaagagggataaaactcatgtaaagaaaagttccttggggtcttcagtaacttttaagagtatacaagagtatttgttgttcagtcgctaagtcatgtccgactcttcgggaccccatgaactgcagcatgccaggcttccctgtccttcactatctccaagagtttactcaaactcatgtccattgagtcagtgatgccatgcaaccatctcatcctctgtcgcctctttctcgtgccctcaatctttgccagcatcagagtatataaaagtatacatcccactatactacagcacaagtttgaaacccatccctgtaagagatgaaaccccagggcaagatttcatcgtgaagcagcacttgtaccacaacacacttctctggcagcctcgtgcaggcgagacccagtggataagagaagccagaccagtcaggaagcggcaggcggtaagagcaaagcagcacagtgaagaacgctaactgccagggctaagacaacagcagaaatacaagagaaaagagtaaattcaaaagatattgttaaggcagaatcaacaaaatctagcaacttcagaagtggagagacttggctgctgcctgcatggctggattgtaactcactatccacccgtctggcttagggataggtactaagtctatgccaaatacagtcaaccctccgcatccatgggaccctcagctacggattcaaccacccttagatggaaaatttccagaaaattccaaaaagcaaaattcaaatttgctgagcatcaacaattatttgtgtagcatttatactgtattacacgcatgtatgcctatttgctcagcgaaggcaatggcaccccactccagtactcttgcctggaaaatgctatggacggaggaccctggtgggctgcagtccatggggtcgctaagagtcggacacgactgagcgacttcactttcacttttcactttcatgcattggagaaggaaatggcaacccactccagtgttcttgcctggagaatcccagggatggggaagcctggtgggctgccgtctatggggtctcacagagtcggacacgactgaagtgacttagcatagcatagcataggttatatgcaaacactatgccattttatatgaaagacttgactatccaggaattctggtatcagtgcagggccctgaaaccaattccatcaccctgcagatactgaaggacaactgtatagatatctacagacattgtaatccagatatgtgttctaatgacacatctcgaacaccaactgggtttcatacaattcaatttaggtagaccccacagataccctggaggctcagatggtaaagaatccgcctgcaatatgggagacccaggtttgatccatgggttgtgaagatgccctggagaagggaatggcaatcgactccagtattcttgcctggagaatcccatggacaaagaagctggcgggctgtggtccatggggtcacaaagagtgggacacaactgagcaagtaacacttcccacagattaagggctcagttccacctcagatgcccaagtctcaagggtccccaagctaccagcacttctgccaggcaagctacaagttcacagggtcccacaaccacacccagccctgtttccccaggttcagtaattcacaactcacacaactgaagaaatcgtcatactggtgattacagtttcattataaaggatgtaactcaggaacaaccacttcggttaagagagcagagtgtgggggaagcgaggtgcagagactccacagcctctcctcctccatagaacacaggggtccacgttcccagctcagtgttctccaaaccagaagctccctgaaccttattattctaagagtcttggatgggattccatcacacaagcatgaatgactaaacaactggccatgagagagaactcagtttccagtttgtcccttcctcttcctcggaggtggtggtggtagtggtgagctgaaagacacttcattaacacaaattcaggttaaggtccaaaaagtttctttttaagattttttttttccacatgggccattttttaaaaagtcttcattgaatttgttacaccatagcttctgtgttatgttttggtgttttggcagtgaggcatgtgggatcttggctcccctaccctggatcgaacctgcgccctcctccactgcattggaaggtcaagtcttaaccactggacctccaaggaaggtgttcagtttgaataacagaaggcattcctatcaactcagggaagtccaaaggttttaggagctctggaaccaggaacaaaaactatcattttctttttttttattataccagggcatggttgttgatatacggcaggtactcaataaacaattgctaaagaatgaacaaaagggcagataacagcatcattcaccagaatgggaaatacaggcagagaaaaaggttgtcagaagaaaggcggtggtgagctctgagttggaccgactgtgttggaagcacccaaagatcacaggcggaactcaaagggttagaccttagaagaaaggtcagagctccaggtatgaacatgcaaagataatgggacttaatcctggcagccagaaccgacagtggtcatatgaccatcctagagaacagttcagttcagttcagttgctcagttgtgtccaactctttgtgaccacatggactgcagcacaccaggcctccctgtccatcaccaactcccagagcttgctcaaactcatgtccattgagtcggtgatgccatccaaccatctcatcctctgccatccccttctccttcctccttcaatctttcccagcatcaggatcttttcaaatgagtcagctcttcacatcaagtagccaaagtagtggagtttcaacttcagcatcagtccttccaatgaatattcaggactgatttcctttaggatggactgactggatctccttgcagtccaaggggactctcaagagtcttctccaactccacagttcaaaaacatcaattctttggtgctcagctttctttatggtccaactctcacatccatacatgactcctggaaaaaccatagctttgactagacggacctttgttggcaaagtaatgtctctggtttttaatatgctgtctaggttagtcatagcttttcttccaaggagcatcttttaatttcatggctgcagtcaccatctgtagtgattttggagcccaagaaaataaaatctgtcactgtttccattgtttccccatctatttgccatgaagtgattggaccaggtgctatgatcttcgttttctgaatgttgagctttaaaccaactttttcactctcgtctttcactttcatcaagaggctctttagttcctcttcacctagaggtcagggtaggatcaaaaagggtagagaaaacagccttgggaacaataacgttaaggactaagaagtcctagatgtaagagaagagaacacacagagcgtaagatggagaaaggcgaggcagaaaaatgttcctacagaacatgttgaaggtcgtggaaagatcgagaaacagactgacagaagatggtgcatggaaacgagatacaggaggcagaggcaggctgcaagactgtaacacgcagccaggatcaggagacacccggcacagaaggcagagacgagagatgcgacaggcagcgctgaggggccaaagctgagcggccgggaaggagggagcagagggcagggggccatggaggccccggcggcagagaacaagcaagattcagattgcggctcccagatggcccttccgtacacgcctgcaaggccctgcacggcctgagctcgccgccctctccagtattcccactgcaaccacagtggccttctactcaaacacgctgtgcccctttatgccacaggccctgtcacgagctggcccctcagcccaacaacttctttccttccctgatgacttcctagacatccttcagatgccaagtaaatgtcacatcttccctagactgtaggacaacgttaggtcctcttggacactttcgtcacagcatttcaaacggtgaggaatcatttctttctgcaactgtggggacagggggtatgtacgtctgtcctaattaaagagtgaggacagcaacctgtcgccgctgtcccctagctcctaccatagcatctgcacacagcggtcacacacgacggggttgcagcactaatgaggggccttccgagcacaagcacgagccagagtctccgaggaaaccggggaggacagcatccagaacccagggaagggaaggcgacatctgcctcttccttcactctcatctcaaaaggcaaagcgtggatcagataaatttacaagatctgcctgggaagcgggcacctggaccggacaggaggaagagccgctcctgagagtgaagcttctgagacatccggggagggctggggaggcctgaggaaaagggcagatctggaacagcgtctatgcagaaaggaaagaaaggtgaggaagaaacctatttgcaggggaggaacagagacgcagatgcgggggaatggacttgtgaacgtggggtgggaaggggagggcaggacaagctaggagactggaattgatgaacacactgcgggggtgggggcagggggcttccctggggacgcagatggtaaagactctgcctgcaatacaggagacctgggttcaacccctgggtcgggaagaccccctggagaagagaatgacaaccgccttcaggattcttgcctggagaattccatggacagaggagcctgcaaagagtcagatatgactaagtgactaacacgcacgtgtgtaaaatagatagctagtgggaagctgctgtataacatagggagctcagctcggttcgtacctgtatatgtacctgtatacatacagctgattcacattgttgtatggcaacagtgtgaaacgaatacaacatcgcaaacaactctattccaataaaaaatagtaaaacataatttaaatatatatagaatattgagagtgaagaggaaaaaaagaattcttagcagaatacaacctgaggaagaatacagctaaatgggtaaagacaaagtctgcaagtttgtatggtcttctttggctgatttttttttaaggtttttaaaattaatttattttttattgaaggataattgctttacatgcctgatttttaatatcacaaatacaggaaacagaacccagagagttgagctggtcaagcgaaggaggtcggtggatcagaagtgacagaaggacaatagggcaaggaactagctggggtgacccaccctgaggtcccagctgtagggggtaggaaatgagacgaggaggaaactgacaatatgagattaaaggaagaaggtccaggaaccagtttttgagtggaattgttgtaatcagaatgtgggaaataaattacactgcagatatataatttaaaaaacaagtgcaactgttctcaaggtaccataagctcttaccacctactgttatcagtctcataggacaaaacaaaacaattctcaaaaataggcctgtgcccttctgaaaaaggtcaagttgctattttccttggagtctaacctaaaaaagcagacacattaagaaataatacccctacaaagaattaatctcaaaaatatacaagcaactcctgcagctcaattccagaaaaataaacgacccaatcaaaaaatgggccaaagaactaaacagacatttctccaaagaagacatacagatggctaacaaatacatgaaaagatgctcaacatcactcattatcagagaaatgcaaatcaaaaccacaatgaggtaccatttcacgccagtcagaatggctgctgtccaaaagtctacaagctataaatgctggagagggtgtggagaaaagggaaccctcttacactgttggtgggaatgcaaactagtacagccactatggagaagagtgtggagatttcttaaaaaactggaaatagaactgccttatgacccagcaatcccactgctgggcatacacactgaggaaaccagaagggaaagagacacgtgtaccccaatgttcatcacagcactgtttataatagccaggacatggaagcaacctagatgtccatcagcagatgaatggataagaaagctgtggtgcatatacacaatggagtattactcagccgttaaaaatacatttgaatcagttctaatgaggtggatgaaactggagcctattatacagagtgaagtaagccagaaagaaaaacaccaatacagtatactaacgcatatatatggaatttagaaagatggtaacgataaccctgtatgcgagacagcaaaagaaacacagatgtatagaacagtcttatggactctgtgggagagggcaagggtgggatgatttgggagaatggcactgaaacatgtataatatcatatgtgaaacgaattgccagtccaggttcgatgcatgatacaggatgctcagggctggtgcacagggatgacccagagggatggtatggggagggaggtgggaggggggttcaggatggggaacacatgtacacccgtggcagattcatgttgatgtatggcaaaaccaatacaatattgtaaagtaattagcctccaattaaaataaataaaattatattttaaaaaaagaacaaaaaaataataaaagggttcattcctaaaaaaaaaagaaagaaataacatccctttccagctccagctttttcctagtatacatgtttccccggcagttccagacaaatcataagttagaatgcctccagatatgagccaagagaatgtaacctaccttcgggcatgaaaaaaaatctgtcattatagtagtagtcaaactgataaaataatgcccacagttctaaaccaaaagtgatctagctatattatagataagcagcacaaacttcattctatctagagcaatcacaggacagtagtaaaatatatttcattttaaaatgaatgaacaatacaaattcttgggcagcagagtgagcatttaaatttaaaaagtaaactttattgagaagaaagttcatgcacacattgggttgctttgatgtttttgtattatagttttactaaagactatcattcaagggggaagttcccctggaggagagcctggcaacccactccggtattcttgtctagagaatcccgtaaacagaggtgcctggtgggctacagtctatagtgttacaaagagtcagacaagactgaagtaacttagcagcacaccattcaaaagggaaaaaaaagaaagtcaccatcagcccctttctgtctgatcgctgcatatgatgagtgtgttgggtatgcatttagcctgcccagcgttctttcttcttgtagttgatccactttctctcctgctaattccaggggtctagctactgactttactagctactttactttacaactggtacaaaaggtggacccaaaacccaggacagccaatgagtgtcttgcattcccttggccatggtgactggttgaggcatgggatcatgccaggacaatcagaacccttggacctaacagacagatatgtaactcagtaatagttgttgttcagtcgctaagttgtgtctgattctctgcaaccccatggactgcagcttgccaggcttccctgtccttcagtatttcctggagtttgctcaaactcatgtccattgagtcgatgaggccatctaatcatctcattccctgtcgtccccttctcctcttccggccctccattggtcccagcatcagggggtcaatacatttcccttttttactgaaggcagtttgggcttcttccacttgcaaatgaaaaaattcagacaatacaattatgaataaggagaattacagcactgagttttctttcttctactacaattctttcttactcttcctaccattctttcttatatatattttacttatttatttggctgtactgggtcttagctgcggcatgtgggttctagttccctgacaagggatcaaacccagaacctctgtattgggaacgtggagtcttaggccactggaacaccagggaagtctctatcattcctttttttcccccatccccatccaacttcttcattatagcagactacttaaacttagcactgagtacttacgacacgactgaaacaaaaagctaatttgacaataagcctagccccaggtaaattctttacgatctgagccaccagggaagtggtagctcagacattaagagtctgcctgtaatgcaggagacctgggttcaatcgctggatcaggaagagaagggagaagggaatggctacccactccagtattgttgcctggagaatgccatggacaaaggagcctggcaggctacagtccacgggattgcaaagaatcagacacaactgagggactaatactaccacccaccaggtaaattacactgtgattcaatttcttgatatttagatagtaaagttaagagtcttctttcagtttctggaagagtacatgcttaaacagatgcagtatcatttctttcatgaggtcaaaatgttatatgtatatgaagggaaattactccaccaaaattctaggacattttgaaataaattcaaaatctcttcctttttgtttttcttcacaagagatctgaactgacttaagaaaggtcaccacatgtgcaaaatggactttctaataaaatcgtaattgtgtgaattagcttaaatttgtgcacttctgcttctcttgctatccttaattttttaatttaatttttattttatattggaatatagctgatttacaatactgtgctaagtgtcaagtgtacagtaaagtgattcggttatacataaacatatactcaatcttcttcagattattttcccatataggttattccagaatactgagtagagttccctgtgctatacagtaggtccttgttgattctctattttatatatactactgctaagtcgcttcagtcatgtccaactctactcgaccccacagatggcaacccaccaggctcccccgtccctgggattctccaggcaagaacattggagtgggttgccatttccttctccaacgcatgaaagtgaaaagtgaaagggaagttgctcagtcatgtccgactcttcgcaacccaatggactgcagcccaccaggctcctccgtccatgggattttccaggcaagagcactggagtggggtgccatcgccttcccctttatatatactagtatatccttaatttttgatgttgctgttatatggagaaaataataataaattcacaacgtcctcagatgatagtcaagaaatacaagagataaggtaggattatagaaagaatacagggctgaaaatgaagagaaggtttaaacaacccaacctcagctggcttcagctaaaaggtatatagcaggtggggtggggggagagctgttaatcttaagaatacaggacttcacagaacttcacagaacatgaaaacacccagccccagaaaggactggaggaggaggtttaaagtaatctcaggtggtattctctcttcctgcttctatatacttaatttaatctctccatccataaattacctttctctgtccccagacacaacagcagaacacaacagcctagaactcccaagtttttacgctgggccctgtgaatgcagtgaggtcgaaccctcacttgggcccaaagtcaatttccaagaaaaggacactgattggactagcttgggtcaggaccgaactaaacctgattaaatcctctgtgtattctgtggggaggaagaagtatgcaggggagtggatgtctagatttgaggacagttaagggatctatgtcgagttagacactccagaagttcccactacacagtcctagcactgtaccctggttttttcatcatcacaggaaaggaactgctcaccaaagtccacttgcgactttttgtagcagagtttaatagaactcaagagaattaatggaatttaagaaattagaggctgactagcatccaccactggtttgttttttttgggggggaggggggcggcgggagaaggttcatgtcaacaagaaataaaagccaaaaaattataaattctggaaataagaattatcttttataaatatgacagtcaatatgataaacgcaagagaaattaaaaaaaaaaaatcatgaggtcttagagagctgagaccgctgtcacggttcaaggctggacagccacagcactgccagatacagagcacgtgctcaaacagtcccactgaccaaacccagagcttctcaaccgtagctctttaacacgggttacagatgtgctccaggtaccaaggccctcaggttcgggggatgacacctgccatgagtactatttactaggactaatggggtgcaaatattatataatattacaaaagttgagacacactaaataaatgaccaaaatactactggaactcaagagttctagcaaggtggtgagttaccaagtaaatctgagtaaggtcaataaacgtttaatcagtgttcaactcatttttgctttgcagtcgctaagtcatgtctgactctgcgaccccatgtactgtagcccaccaggcttcctctgtccataggatttcccaggcaagaatactgaagtgtgtggccatttcctcctgcaggggagcttcctgacccagggactgaacttgagtctcctgcattgtgggcagattctttaccactgagccactggaagccgcagggaagcccagcaactcagtaactgtaccaaaaagaatgcaaattaaaacaaacaaaactggctaggattttcttttttttttgagaaggctttacccaatgctagtaaggaaacaggagatcagtacacactgccaaggcagcatacccttaaggcttgggagtatactccaatatactgagagagttggaatagagattgctgggagaaatatcaataacctcagatatgcagatgacaccacacttatggcagaaagcaaagagtaactaaagagcctcttgatgaaagtgaaagaggagagtgaaaaagtgggcttaaaacttaacattcaaaaaacgaagatcatggcatccagtcccatcacttcatggcaaatagatggggaaacaagggaaatagtgacagactttattttcttgggctccaaaatcactacagatggtgactgcagccatgaaattaaaagacgcttactccttggaagaaaagctatgaccaacctagacagcatgttaaaaagcagagacattactttgccaacaaaggtccatctagtcaaagctatggtttttccagcagtcatgtatggatgtaagagttgggctataaagaaggctgagtgctgaagaactgagcttttgaactgtggtgttggagaagattcatgagagtcccttggactgcaaggagatccaaccagtccatcctaaaggaaatcagtcctgaatattcactggaaggactgatgttgaagctgaaactccaatactttggccacccgatgcaaagaactgactcatgtgaaaagacactgatgcagggaaagactgaaggtgggaggagaaggggatggcagaggatgagatggttggatggcatcaccaactcaatggacatgagtttgagcgagctccaggagttggtgatggacagggaggcctggcgtgctgcagtccgtggggtcgcaaagagtgggacagaactgaacgactgaagtgaactgatactgagagagaaacaggctacacaactatacgtagctgaggttataagctggcaaggcaacaaagactgaatgcagccgtcaggtctgctctgcctgaatcccagtgggttattagtagttgtgtctcacataaaaattgggagatttcacataaaatctgtatttctaaattttcaacttctcttaaagacctagaaggcgtggaagcaccaagacacaacgggccgggaatgtgtgggctgaccaactctgcgctgtcccatctccaggtcccagagtcccaaacaggcctgcgagtcacccagaccaaatgcacctatgcttctaggcgatctgagcaaagctgacccttcccagcgtatggacaggcatcatttctggtcagggagatttggagtatgcttttttacacccttacctgtattttccaaagctgtcttcaataaacatgtatcgttttggtaataagaaaaaacgtgttatttttttaatctcccaaatcacaactgcaatatcacttcatcacttcagttgttgtaatgagatcacaacaactaaagataacagataatgactatggtttaaaactaattgaactaagggagtaacataaggttacaattaccgcagtatttcccttcctttgatactaattaaaacaccagattggacagacaatattagcacttaacaaactggatctcccttcaagtgcatagcttctatagacactcaattcataaaaccctattctaaggattcatttccatacattaagtttctttcaccaaaaaatgcaagcagaaaaatctctcctaccagaaatctgcagccataacctcaattaagttaatggttaaaaagttaaattcccgatctttattttacacgatgttaatcgatccataagaatagtgattttacggggttctcgtcctcagagaacttcaaaaagtttatacaaatcgccattcatctcaccccatcaaagagtaaatcacactaccttcacggtgaagaaaaagtacaactttcaggtaaccgacagcaaggggtggggtgggggggtctgttagttcaacatctccctctcagtttcgtccaggccactcccacataacatccagagggatctagtcaaacaaaagggtctcccctgcttaaaactgacatcagcatcctgcctcctctgactctgaggaaaatccaagccagagcctgtctgctttgtcccagggctcacctgccctggggccagcacatggctgctgagtgtccaccatgccctggaccctgctcccggttgtgaggccaagccttcctctcttgtggaacccacccctactcaaccgccctaccaagttctcctcctcagttcctctgatcatctttcttttttcatttctttttttctgttttgagaccgcttacatttgttcataatttgatttatgtatctattttcagccatgcttggtcttcgtggctgagagggcccttctgtagctgcaaagagcaggggctgccctcctgctgcggagcacaggctccagcgcgtggaggcctcagcggccgcggctgcagcacagacacagaactgttgcacacaggctccggtgctccatggccggtgggtcttcccagatcagagaccgaacacgtgtatcccgcgctgacgggaggattcttcagaatacccaaacagcaattttattaactatatctcaaggtatctgaaaataagcagtactacctataacacacttattgttattgactggctttgtttaacaatacttttttgtaagtgaagaagagaggaggagggaattttaatcactgaagcctggtatacataccaggaatataccactaattgtttggtcaactttttactagctttacagcttttatatgtcagtgatcaaaatggaatactctaattctgtaagaatggagcagttgactttcaaatgattccagaaactgaaaggctacttgcttctaaaatctattatctttacaggagaaatgaattgatttttataaaacagtggatgcacaacaaatactcttgttatagataatgcacaggaatgggtacatgtgtgtgtttattcaatggcttataatatattacccttgttacagggtttccctggtggctcagtggtaaagaatgtgcctgcaatgcgggagatgtgggttcaatctctgggtcaggaagatcccctggagcgggactcgcaacctactccaatattcttgcctggagaatcccatggacagaggagcctggcgggctgtagtccatgggatcgaaaaaagtcaggcacaactgagcaattaatgcttttactttcacccttgttagaataaagcaggtcagaaaatctgcctcagagagaggtgagcaggcctctacacaagcacaataaatggctccaatggcatcttgtcccctagcttttatcataagagccagtgttctccttaaccaggccggtgaaaacatggcagaaaagccagttgtctttgcccatttcctgcagttgtatacaccagtcaccagagggacttgcaggcacaatgcagggatgaacacaaccatccctgagagagaaaccagtcaaaatgctccccaagccacagagaagccaaagctggccctcctgcatgaaggagaggatgtttaattttaaccaagaataaaaaaaaaaaattctgaccaactgctgtgaccttgtaattttcacattcaaattcaggtgagtctgaaactatcacatccctcggttcagctcctggctccaccactggataaggactgaaggggcctcaggaccactcccacccggccgggtggagccctggcccacacagcactgagaagggttttggtaaccagcctaccactgaactggggcggtcctgcctcgctcaatagcacaaactcaggccagagagctgaagccaaaatgatttcaccaaccctctctctgggagataagctggcaaggtaagctgccaatcattaatcctactagaaaaaaaggtgaagagagcgatggcgaattcaaacagattcagttcagtcacttagtcgtgtcagactctttgcgaccccatggactgcagcaaaccaggtttccctgtccatcacccactcccggagtttactcaaactcatgtccattgaacctgtgatgccatccaaccatctcatcctctgttgtccccttctcctcccgccttcaatctttcccagcatcagggtcttttccagtgagtcagttcttcatgtcaggtggccaacgtatcaaacagatgaacttagtggaaattcactttgttagcagcctgctgctgctaagtcgcttcagtcgtgtccgactctgtgcgaccccatagacagcagcccaccgggctcccctgtccctgggattctccaggcaagaacactggagtgggttgccatttccttctccaatgcatgaaagtgaaaagtgaaagtgaagtcgctcagtcgtgtccgactcctagcgatcccagggactacagcctatcaggctcctccatccatgtgattttccaggcaagagtactggagtggggtgccattgccttctccgtgttagcagcctagtcattagcaagaaaacatcaatgatcttctaccatcacactttagaagggtttaaaaaaaaaacaacaatctcccagtggatgggtgacatctctacagtaaggccttgcattcctgaactgaacttccaccagacacttcaattctccaacaaggctgatgtggaaatgtttgtacaggctcccggctgcatccctaagctcacttctgtccctaagcccacttgtcttgtgtttccaaggcaggtccacatcaagtaaactgccttttccaactgtgctagtctcctctgtgactctgatcctgtttttcatatggggggtgttaggaaaactactacagaataaagggtagcatactgctttcagaggtgaatgctagacaggataggaggcttatttgtgagctaagttttgagactaaccccttactgagagggctttgaatctgtgtgccagctactttataaatgaatacatgccaggaaactgctaggttagtctcaaacagaaatcaggaatgcaaaaagtcccccaacacccgtacaacatttgcagacaagaggcagtccagcgctgtggagtttgggctctagagtaactattctgcagtcacttgctggctcctgtgacttaacagagggtattttggttttcaagtcacattcatctaaaaaacgagaatttgtaaatattaagtgagtttatgcttataaaatgctgtaaacggacttgataagcgttaggtgttattcttacaggtgtatgaatatccagcttccagatcacatcaccaacatggtcacaataacaacccattcttctttctaaagataaaacaattccctaggttggtcacttattaagtcagtcctcaaaaaaaaggaagggggagggacatggcactcttatacaacatgctgagtgtagactgctacaacctttctaaatgactaactgaaaggatgtatcaaaaacccttaaaccataatatgtactttgatcttacaatcacacctctagaaatttatcctaaaggaaaaaaaaatctcaaagatatatagagatgcatagaggacagttattgcagagataatgataatagcagtgggagaaaaataatatttaataaaaacaaatcagctggggactttccctggtggtccagaggtaaaaaatccaccttccaattcagaggatgtgggttcaatccctggtcagggaaccaagatcccacatgccttgggcaacggaggctgtattaacaaggaagacccgacacagccaaataaataaataaatcatagatctgcaaaatggaacattattcagtcaacattacaactgactacatagagaagaaaagattcataatgagatgctaagaagcacaggttaggaaacaaccaaatgtataccaggatcccatatttgctaccctaagttatatatactgacaaacagcatagagaaaaaacagtttggatagaaatgtattcaggtagtggacctccaagtattttatggttttttactctttactttcctgtatttcaattgttctaccacaaacatgcaattttaaaatacaagggatcatctaactgattaacagattctttctgaaatagtactattaagctgagagggatgacaggcttatctttatttagaaaaaaatctgcatagaacctgatgttttattagttacttttaatgtttagttattactgtaattttaaaattacacatattcagtgccaggaaattagcaagagacttctttttaagcaatggattctacttactacaataaagtacattagtacaaaaactgaacagactagagtttcatacatttttatatatctcaatattttatcatcataactaacatatattaaatgaatgtgtctcaagaacttaagtgagaacttagaagtattaaattttttaaactactgtatttgaatttaatttttaaaattttggccgtgctgggtcttccatgctgctttctttagttgcgtcagggggcgcaaccagggcgtccctggtggcttcgatggtaaagggttagggttaaagcacagcacagcactgcacaactagagttgtggtgcgtgggcttctcattttgccaggcttctcttctttcggagcacaggctctagggcatgtggggtagccgctgcgtcacactgggcttagctgtgccatgcgtggcatgtggaatcttcccggaccagggatcgaacccatgtccactgcactgacaggtagattcttaaccactggaccaccacggaagtcctagaagtattacattttactacaacaattcccattttcagctgagaaaactgaggcactgagaggttgctgctactgctgctaagtcgcttcagttgtgtccgactctgtgcgaccccatagacggcagcccaccaggctcccccgtccctgggattctccaggcaagaacactggagtgggttgccatttccttctccagtgcatgaaagtgaaaagtgaaagggaagttgctcagtcgtatccgactcttagcgaccatggactgcagcctaccaggctcctccatccatgggattttccaggcaagagtactggagtggggtgccattgccttctccgactgaggttaggtgactagatcaaagtcacagaccgtgctgtgtggtgcttggccgctcagtcatgtttgactcttcacaaccccatggactgtcgcccttcaggctcctctgtccatggggattctctaggcaagaagactggagtgggtctccatgccctcctccaggggatcttcccgacccacggatcaaacccaggtctcctgaattgcaggcagattctttaccatctgagccaccagggaagcccaagaacattggagtgggatcttcctcacccaggaacccaactggagtctcctgcattgcacgcagattctttaccagctgagctggtaaagtcagaatatgtatggtcaaacccaatatcctctagaggttgcactcttaactatccataccctcaactacacagcagaagctgttatttatggggcctatgctgggctctgacagaaaggagtgaaggtcatatattaggagtatgaaaaataaaattggaaaattactaattttctttattttgggaaaaaacaattttttattgcattatgttggacttatcataggctataaaatggcattttgatgtactgataccaaataatttaccattatgctgtgacttaaatttacattttgagtctaagcaaacattttgctaggagccttcttttcagcttatcatcttgagttatgcttgggaaaggttctctcctttcagagccaaccaaacttacagaaatgactggggtgtggtacttatgaccagtttataaagtgactatgaaatgataagatgaactttacaagtaaaagtttaaaggtgtggcctcactgtgacgtaattcacccaaatatttcatagagttcctccaggcactactttaggaggtacagtgatctctgcccttctgagatgtattattacaggtgccttacatatctgaaggtcatggtgttttattagatgtccaaggtatgaaagttattctgtcactttaaaaacatgccatcctcttcaggacatggtctggggccactcagtgagaagcaaccacaatgccagtggttctccaatgctactgtgtaagaaaacttcctgcagagcttgttggaaatcagattccaggagtctgtatttttaccaagaacttcaggttatgttgatgtaagtgatctgaggtctagacgttgagaaacctgccagtaagtggaactattcagaagagaaagatcattcacaagagaagagccctacggcagtggaatgtgaactgagtaatataaacccaaccgacctgtaattaattccctataattcacaaatccacattaaagctgagtaagagtagagggatttaatggcacctcctccttaaccccctttatggagatttgagtttgcctcaatctagttatttggagaaaacatgaatttaagcagagttttatttccgataatagagggataagcattaagaaaaaggaaattgctagtcaattgcaaaaaaaaaaaaaaaaaaaagctaagagagacaaacatttcagggaactaacttgctaccactcattttatgccctatttcacaatgcttagtatctgaacaatccacagagttccaaagtacatcaaaaatgtgttcatttcctctcttactcaggcagaataataacagacttttgtgaaggtaccatgtgcctcaaaaatttcaatagatacattcttaaataaagaaatagccttcaaaaacaattctatcagaaattcaccctactggagcttacttatagaagtcttaaatagcttttggactatcactaaattagtgtccttcatttctgaatttggattacctaaagtttttgagttctttacaactgtcctacagaaagaactcaatattgaaaaatgtttttcttcttttgttataagcaaacaatcataaaaataacataaatgtttcaggtgaactattaaaaatttagaaacaaaacagagtattttgttctccataataagtaaaaatcataactttaggaggggtactaaagcttctgcaccttaagtcatgttaaaaataaaggtatcccaacaaatatattcctatttcagacagtaagagtagcactacataaaccagccgggctgctggctccatggtcccatttcctaccctcagatcctgtccactacataaactctgagcctggtcttcatcctttcaaagggattagtaaaaactgcctccccgatgacagaattgagattttccagatgcatttttggcacggtacttcttattattatctatactttttattgcgcttgtttttattatttggacgtcccgaccacgtaaacattaagagcaggatgccagcagattaagcacaaagaaacgcaactattcggagtcgcatctatttaaattttcaggctggtgctgcctccagaatagcaccgaggatggcaaagttctaaaggaaactttcatattcagaggctatcaaaaaatctccagaagcgtcaactcaacacagacgcccctaatggtttttttcaaaagcaaagcctttagtctgaatcacaacaaaagatgcccataggaaatgtaatctacgaaggtgcttcctaatccaaaaggcaaacaagaagtaagagggaaaggcgcaaccccattcctcgtcggttaccttttcctggggattctgattgcattttcctcggtcaagccagacagagcctggtaactgtggcttcggtccacactaaaaccgtgtcagtgcgtaaagaaggggaaagggaagcggccgacaccggggacgcgctccccccttgaaaggatgagccgctttctgtgaaataccaccggagtcaagtcagtaccagcaggaggacgcggggccaaaacggcattgactgcccttcactgacagggtagtttttttctttctttttttttttttttttttttgcgggcggaggagacagaagaagggatgagccggggaggagaggccgggcattccggatccccggcagcctggcggggaggcgaggctcggccggcccgccccactcgggcgaccgcgggcagcgaggtcagccctgcaagggaccccaccgccccgcgtgcccctggagaaaggacgggacctccccccagctcggccggccacggcgaccgatgcccattcaaccccccgaagcccgtcccgcggccgccgcccaccccccagcctctgtccgccgcggagccccggcctcccggcgcgtgccagccggccgccaccaccaccacccacccagccacccccggcggccagggaggatgggaaggacgaggcacaggggcgcctcctgggtgcgcgactcagggtgaagggcgccgggagggactcgcacaccggccccggggtcggggagaggggggtggacgggcgtcccgggcggccatcgcgcccaccctcgccccggccgcctgcccggtgcaaagcaggccgaggcggtccagccctctcctcacctcatctccaggcgggtccacgctgccgcctcagggggacaaaaaaaaaatcagtgcagctcagtcgccgcgggaaggggacgcaggagccgcagccccgcacaccatccccgcccgcctctcggggcgtccctgagtccgcccgggattctccctcgcgagccgccgtactaccgagcaaccaagctgcgcgccctcccgtctccacctcagctctcggcctcccttcgctcccctccctcagtccctcgctcccgcctatctcctcatctcccccgggacctgcctcccccgcgccctctcctcccctccgtctccgcccacggtgggtaggtggggacaatgaaaaaacaaccaatcggaagaaaggactcacacctcctcccgccccctcatctagccccgcccaccacgggggaaacgcaactgaaaaaaaaaaaaactggaagaggagggagtgatagccggatcgacaaatcagcaagctcagagggggcgggacctagtcgccccaaccccccccccccgccgccccgccccctttcccgaagcgggcgtctggtgtagggtttcccgacgtgcctagaggcgtctggtgtggggcttcgggacgttttgttccatggtctcggtgccattaggctgttgctgtgcgaggcgaggcacaagttaggacgccttcaactaactaacggcaggtgtcataggagagaacaatgtggaggcacagggagggcggggcacagtcccaggaaggtgatggggatatggttggaatgaggaagggtgtggtcttgaacatatttacataaagctgaacccctcggcctctaggacttcgcgcattgattggtagccccaggtgcgtcgccttggagcatgccgggagatgtagttccgcgttcggttgctatggcggtcttctcgcattaattggtagccccaggcgcgtcgccttagagcatgccgggagatgtagttccgcgttcggttgctatggcggtctctagagtccgagactgacgagcggcctggccaatgggaacagcctctggcgcttagggggtgggccctctgctgaggggcgagaaggtggcggaggtgaagctgcaggccgttagtgccgctccgagccaggtgagcaccgggagacgcgctacgtgtcttgggaaaccggcctttgggcggaagctcgggagacgccccgcgggaccgtccagccctggggcgcagggtggtttccgttgcaccccaaccttcttaacacctctcgggctcaggcctagctggcttagctgaggccgctgaggggagggagatacttgatttgcctatttcctggtttttactggttttgatggtggatgttatttcagtttgcatcttcctccactttcatggaagcaaaagtctcgaagttcccttccaccgagactcccagtttggattttacccactcccgcgtctttttgtttctatacttttgagtttctttttctttctggcttactacttctatactactgctttctcctccgtcacttttttttcccccgttgaacaattacgtaaagcaggggcattcggttttatgtaactctaggtccagatttgccctccagatttaagctaaacggaggaatactctggagcaacgcgtgaaaatcacctcagaaccgttttgaagtgcagactatgatgctgtgggtgtgggcgggccctgagaatctccatttctgacaagctctcgggtgctgctagtccaggttatgggcagcaaggtttgcacatttaatgggagccactttttttaaataaagagaaatatgtgaaattaatgctagagttttatttaacccagtatatctaaaatagtatcatatcagcacacaatcaaatgtttaaaaatcaagattttgtacattctctcattttcttcacattcgaagaaacctgatagacatcttttgctaacagtacatctcagttctgactaggcatagttcaagggctactggatgatacaacccactgcagaaattaaaaggtgttaaatcttaggttgcccgtgacaaaaccccttactgctctgtgagatggactttggaagtactttaccaggtctcaactcaatttacagaaataatagcacgaatatccagcattcatttaacacttcctttgtgccaggtattgtactgagtgctttgcatgtattatttaagcctttctgttactatccctgttttacaggtgttgaatttaaggcccagatagttgaaagtatttagtgtatgtggcggagaaggcaatggcaccctactccagtactcttgcctggaaaatcccatggacggaggagcctggaaggctgcagtccatggggttgctaagagttgggcatgacagagcgacttcactttcacttttcactttcatgcattggagaaggaaatggcaacccactccagtgttcttgcatggagaatcccagggacagggaagcctggtgggctgccatctatggggtcgcacagagtcggacacgactgaagcgacttagcaacagcagcagtgtatgtgggtcgtacactgaataagtagaaaagccaggattcagaagtagggtcacttaggacttctaaatcctatccatcaatcaccgcagtgtataattattacattttgtcactaatttcaattcattgatgcctctgctctagtttatggctaatcctgagacattcagatttcaaacagagggggttcaccatacaaggcaaagttccttcagttgtagtgacctattttggcagtcttacaactctctgtgctgtccattcaatatcaaagttctaaattgaagaagagcgttccaaacctcaaggagatatataggcctttaaatcagtactatatgctggacagtagtgtgtcttggttcatctgtatacctctttgaaagaaggcttgggaattcttaaaatgtttcaccttgcagtcacaatgttttggggtttgtttttggtgaaatctttcattcattgataaaagtgaatcttttcttgctcatgcgaacttcacatggaatagttcaaatacatctttatttagtatttttgcaaaatgattttcttcttgtacattgtaaagatgacatctcgttaaattatcttcccttgatggtgaatttattagtaaatatttaatcaaaagtacagttcctactttgcatctgaagtaatgattaaagagcctatagtgatttagagaattaaataaatgttggcagactgcagtaagattggtctgtggagaagaggatcccttgcatcggttggcaaggagggagagtgtagtaacagtagggagggccctcagtttaccttcctcatcctgtgccttgtcccagtgccacatgactaagccagcggggaagggagactggcattcatggcaccatgggttccactgttccccaggagtacagtatggaaaaatggaatgccaactcagaaatataaatgaaagttatgtttccgtcgttctgaacttactgtattaaatggccctacatcgaatacaaactggagcagtgacttctaatctacgaattaatgaccatcccgctttcccaaagcagtacccaccccccagcagtactggcaagggggtccactagtaagaattcttaagtgaaaaggtattttgtaaatcagcaaataacaaaagttaagctctcttggagggaggagaattaatcaaaaattcttttgagattcagaagaggtcattgttggaagccacttgttgcatggataggcaacagtttgacatagctaattacatgcctcttgtcttgcttccacataaagcctttattaaaaaattattttcctttcctaattcttcacctatctttagatctcagcttatgtgagatgtcaagaggatgccacacttgtatacaaattcaatcaagtatgtcttgataatgtccatataaatctagactctcataatcagaagactgatatggtcatctcatccccatgcccctcaactgatgcttgaatctcctttatgatgctgctgtaaatgtgtatccagcctctagtttggagaaggcaatggcaccccactccagtacttttgcctagaagatcccatggacggaggagcctggtaggctgcagtccatggggtcgctagagtcggacacgactgagcgacttcactttcacttttcactttcatgcattggagaaggaaatggcaacccactccagtgttcttgcctggagaatcccagggacagggaagcctggtgggctgccgtctatgggatcgcagagtcggacacgactgaagtgacttagcagcagcagcagcctctagtttaaatccatctagtaatagaccatgtcacttcaagcatctgcctaagttttgtatacctaaaatgtgaaagtgaaaagttcttatgatatgtgctactagctagaaatgatttccagagtttagctaggtgtgagccaccatcacagcgtctcccatgcccatcttgtaacaggcacaggagagcagtacagtgtataacgccagtgtattcattgtttatgtgtccttggaatttatagatttctggagactgtctccagcacaatgtagagatgtcccttcctctttaggaagcagagctgacctgtccagataggactaccagtctcctctacagcctgcaaagtatgtggtatttgaaccagacctccagctagtttctgttttgttgaccgtaataggttttaagggtacatggtttaacattcttctttacctgatatgtggatatgtgtgaaaagtcccacaggtggtaagaacatggttaaaacttaagcacctcttcagtataactgaagatttactcagcctggcaagatgatgagcataatagggccacatttcagagctgacttcatctgttgttgtttttttttaaagtagcccagctgcttgacagtttgtctgctttccttaaagtaaaatgagggtgggtgaagcataatacttcactgtattatgaagtttgtgttgggaataatgaaaatttgaacacataagaagagtctggactttgaagttgtccacaggtgtgttgtccacaaggagagaaagaagccgtgcagcggcctgtggcggtagcccaggcctcaggcatcacaattttggcctgtcattgtgctaacatctaagatgagcacttaagccaggagattaaaaaggaaaaggaagcctagaggagggaattatgggagattctaagataccctcgatggctgaagttggcacaacaaaatctcgtttgggggcgggaaaagtaagtctggttttatgactgttgaatttgaggttgagctgatactcagaacacttttggtctgaaggtatagataaggattgatctatagaggttttacttacaatcattaatagatgagctccttgggggagcaagtatagcaggggaagagcaagtgaggctcgtgttgttataactaagaggaaaccatttgaaatgtcttcccattgatttttttttttagaaatcctttaaaagattagtactttcattaactactttcttggtattatttatggtaagtgtttaatttatgcaaagtctttattctgcttttataccaaaaattatttgtttttgtttctccagatttataataggtttaatatgttgatattataaaaacttaaagtattagaaacgtaatcttcaatttgtggacttacgtgagatatatttaaaattggacgtaactgaagaattatcaataacctcagatatgcagatgacaccacccttatggcagaaagtgaagaggaactaaagagcctcttgatgaaagtgcaagaggagagtgaaaaagttggcttaaagctcaacattcagaaaactaagatcatggcatctggtcccatcacttcgtggcaaatagatggggaaacagtgtcagactttatttttgggggctccaaaatcactgcagatggtgactgtagccatgaaattaaaaaacgcttattccttggaaggcaagttatgcccaacatagatagcatattgaaaagcagagacattactttgccaacaaaggtccgtctagtcaaggctatggtttttccagtggtcatgtatggatgtgagagttggactgtgaagaaagctgagtgccgaagaattgatgcttttgaactgtggtttggagaagactcttgagagtcccttggactgtaaggaggtccaaccagtccgtcctaaaggagatcagtcctaggtgttctttggaaggactaatgctgaagctgaaactctagtactttggccacctcatgcgaagagttgactcattggaaaagaccctgatgttgggagggattgggggcaggaggagaaggggatgacagaggatgagatggctggatggcatcaccaacttgatggacgtgagtttgagtgaactccgggagttggtgatggacagggaggcctggcgtgctgcgattcatggggtcgcaaagagtcagagacaactgagcgactgaactgaactgatagtagaatatataattttgaggttaatgacattcatttttggaaatagcatgataaatagtatatatttaatttttatttttattttacgaagtgttcagttattgtatttcctgtgtgccaatgtctttatgttcaataaaaattttattaaataatggattaagtgttccatttaatctggaccactccctaagaaattaagtgggttttgaataccatttgttgtaccatttctctgtggtgagaactcagttttcctttttgggcttgcaaaataaatatttccttaattttcttctggtcacttttataaaaatacttctttttcttcactttgtaattttgagaggtggtttttgttcccacctggttccttattgaatcaacaactaaacattacttttttctaccagccaggctgattataacctaatttggaggaactatttagatgatctgaccaaaaatatgggcattattatgtatataatagtcaccttaagggacaccatgggtacatacaaacagcttccagggtctttgaagttggggtgcatacagtatgagactcctgtgactgctgatctgagagagatgctatttgttttcagatgcagtgggcagagaagacagtggcttccagagtcacaaagggagatgttttgaaatcaaggtgttgatgtgtaattatttcatttctcaaaaagacaattctagtggctccagattgagtgaagcagagttttatttattcagtaataatgggatattgattcttcaaagctgggagaacccactagttgaatgaataaagcaaggttttgtcagtatgtaatgaaatctaaaagcatggaacagatggagtagactgcgtgtcactgggaggtgatttcagagagggagtaggacttgagctttgtttactttgcagaatccgtagagtaagtacagcacagtctcagagagcaagcagggcctggagcctggagacagcggcggccatatggtatgaagttaacttggcttcccaggtggcacagcagtaaagaatctgcctgccgatgcaggagacgcagaccctgagtcgggaaggtcccctggagaaggaagtggcaacccactcccgtactcttgcctagaggatcccatggacagaggagcctggcagactacagtcatggggtcacaaagagacacgactgagcacacacgcacacataatgcctagatcagacgggatgtgttggaagaatgaaggagtaaggtaaactagggacagtggtatgcatcttagatggcttgacagctaggaagaagttagatttctgtcatcggtaatacatagctgctgttctatgcttaggttcttcccctctcccttacaaccctgacaaacttactgatgtgtgtacacacacacacacacacacacacacagatcttccttaaccagaagcctagagacatgtaaattctcttcgtgtctagaatgtgtactcgtttctgttagttccagcatttgattaccacctactggaaagcagcaaccattgctgaactgcttagtaaaaaccctctataaagatcctttagacccgttacgattcagcttgcagagccagcttcataagaacagtacctctgcagtcacactggactcacagtcagaaggcactcatgcttggtttgatgcttggctgttaccatcttgaaattttagtttctgaacaaggttccccacattttcattttgcagtgaactctgcaagttatgtagctagttctgtcaacaagcacttactaattatgaatcctgaactaaaggagatagggttctagttttacatctaatgttagcagctcaatagaaaccattaagtataatggtaaaggtaaatgactttggagttggtagcatctgatttgtctcagctctggcccggctggagccatgagaccctaggaatgtgcctctgtaagtctcagtttcgtcgttcataaattcaataatactgtagtactttcatcaaaaaatatgtataagaatgttcttagcaggataatttgtaaacgtgttaaactggaaaccatcagatgtctatcttcagtgcagtggacatttagtaattcatacagtggaatactatgtaactgaatgaaataaatacaactgcaggcaatagcatgagtgaaactcataatactgagagaaagaaggagcataattcatataaagtcaaaaacagacaaagctaatctccacttgaatatcaggatattgagtatccttagaagggggatagtgactagaagggaagccaaggaccttctggagttctagtgacatgtttcctgctatggcatggccatgttcactttgtaaagttcaccaagctatatacttaggatctgtgaacttttctctgattttatatggtacctctataaaatttacattacaaaagtcttgtcatacaattactatggaattaaagaaacagttgtggaatccttagagatgcttcaggatgtccacagaatacaggtttaattgaaggcaggaggagaaggggatgacagaggatgagatggttggatggtatcaccaactcgatgggcatgagtctgagcaaactcagggagatggtaaaagacagggaagcctggcgtgctgcagtccatggggttgcaaagagttggacacgactgagcaactgagcaccaacaaatgtcttgtaaatggatacagaggaattagggacacaatttcaatgactgtcttgattatccactttttcctttccagtggacttttttaagactttgaaagccctttaaatgacacttttggttattaaaattgagccctctggcctgcacagttttttttttttttaggtacatctcataatttttgttgaatagtgagatgaacttaagtcttggtgtgaaaggctgaattataagcccattctcaaatgcgtacctgaggttattgcatattctcttgtttgattgctttcaagaactattacctaaattcatttgaagactgcagttaaactgtcattttatcctttagaactatttttcattttatgctttcacttcatctggcatatgttttgttggttagtatatttcatgtatattttttcttttatcatttttaggtgactatgaaaggcttgtattttcaacaaagttctacaaatgaagaaataacatttgtgttccaagaaagggtaagaaaaatgatttaatctttagatggaacaagatagtgtattttacaaatgtcacagacctagttttaaataccccgttacaaattatttttgagtggcaccctataaattaattttatgtgaaaacagtggtcgatatggtataactatatttttaaaagagttgctgcaaaagagtttttagttcctcagtgtggtagtataaaagataataagaaactaaacaacttgagtagtcttatgtattgcaaaattaacccaatttattctgaataccacaataaaacgagtttttagattgcagccatatttcagaaaatactttcatattgtgaaattaaagaggtggaaaaacattgtttttcacactaacttctaagcattgcaaagttacttcatgaactaagctttaaaggtttccagttttttttttactactttaaggatagagagtagaatttttatctattaatgattgtttgaaaggtttgtggcaggccaaagacattccactattagtttagggacaaaaactaaatgcgtatgtatttcatattgtatgtgtgtttcatagtagtaataagaatctctggataacgaatacaattcagtttttctttttcatctttcaacaactccaaaatcacttagattaggagtctaatcagtttagtttctaccattgggtcaagaggtttgattggctctcggaaataattatcaccaggttcacacaatcatgagtataaaattatcgatactgctgaatatcttcacataattaccaaatattatcaaatctgagttttaaaaagggaaatcccagaatactgtgttcatgtcaaatacagtgatcacttggttagaacacaggaggcactgcgcaggtagctgttctagccaactagccaacacttgatctaattttggggcatatcaaggattgaagaaagcattttaattactgatgtcattggtagatgacactaaataccaacgtttgaaatacctttgcctttgaagttatatctagctatggaatatgaggggtaaattaagttccatcaagtttgtatttcaaccccagagtcccatggggcatgctaaaatgtccaagacagatgttaaataaggtagaaatcaacaagtgacactaaagaactttctatatagcattaagaaaattccatgatcagtacagtgcatctattaagtatatatgtgtttaaggacatccccacatgttgctttgagatttaaattgaactgaaggacagtatttattgctccactttgttatcctctgttcattgcctgcacatatattcttatccatagcttggaagtacgttttcagattagtaccctaagacttttgaaattttttaccccgaattccctacattctttcgtattatatattataaagtaattgtttgtagctttttcagttaactttggtgtaagattttgagtcttttttattttgttcagttatatatgaaaatttttgcaacatgaaagcagtattctcaaaggaatgtgcaattttatcatttgactctaggaaaatcttcctgttacagaagataactatgtgaaacttcaagttaaagcttgtgctctgagccagataaatacaaaggtatgaatactaagatattggtgctttgatttggccaaaagtcaaatatatttggtatacaaaaattatagtaatataactgacttctgagtaccaagaaattattcctagaagaattgaacagctaggaaaaaaacttaccatgtatttctatattaattagtatattatttctatattaatatataggctctatatctatttaataaatattaattaatgatatagaaataatatactaattaatatagaaatacatggtaagtttttttcctagctnnnnnnnnnnnnnnnnnnnnnnnnnnnnnnnnnnnnnnnnnnnnnnnnnncataatatagaaatacatggtaagtttttttcctagctgactgagcgactgatctgatctgatctgattaattctatattaatatatatactaatatgatttctatattaatcaggaaattccatctaattgaactcatgtattttataatattatatgaaaatattttatatgtaattgtgttagatggtaagtttacagatagaaatatctctatgtattttctaagataatggagattaaatggtagctaattgatttgctcacacattaaaattatacatatcaacgaatcccttagcaaacctggcttcctgctccacaaaggaacctattttgtgaagatacttgctttttgtcttgatgccaaaaatggagtcatatttgctttttctgtggtttgatttttgctcctgcttttctcttgtatgaatagaggttagaatttattcttgacaataagttcaagcctttgtcattatttagcttcttgcagaaatgaagatggaaaaggaattctttcctgttgggagagaagttgctggaattgtgttagatggtaagtttacagatagaagtatctgtatttattttctaagataatggaaagtaaatggtagctaattgttttactgacacattaaaattatatacacttattcaatacaaagaaactatacagaagtgtttttccttttttaattaaaaagaaaaatagaacttaatggtattttgtaattgaagagcttattacagtttagtaaataaatatttagagattatgtatttaaatccacaagcaatcatttggagtagcatgaccagcattgtcctttttatgatgtgtacaacccagcataaattacttgtgtaacttggctttgggtcaaaatttacataatgctcaatagctgcactcacattatatttttaaggtgtgcctaaaattgagtatttaaaaggtaaatagggacttacttccctgccaatccaagtggttaagactctaagcttccactgctgggggcacaggtttgatccctgatggggaaactgagaccccgcatgaagttctgggcaacagtcataggcaggatacttggcagaagaaaaaaaagtttgtcaagaaaattccccttcaaaaattgcaggataaaagatatctaacaaaatcttttaatgatggcatcaacactgactccttcccccgcccccaaaaaaatgaggtgggagggtaggcaagggccagatcatgttgaatctcatctctcaggttgggttgtagagaacgtattagggtgaccatatgaagagtggatttgaggcagaccggactgtaggcaagagcactgtttgagccatagacccaacaagcaagaaatgacaaagtccataacctagacagatgtggcaaaggtagtgtggatacattcaagaaatactgggaaagtcaagtcaacagaacttaataattgactggaacaggagaattcaaaacgcgtaaaggcaggaaatgatttacaagattctggttatatctgaaagttgtcagcgtatcggttgtgtttgaaatcatagaatggtgatgagctcatgcagggagagggaggagatgaaggagacacacagattgcatggaccccttggcagtgccaccatctgaaggacaatccttaataaaaggagtatgaaggacaccatgaaaaaaggatcagggttattttaggaagacaagaatctgcagcaggaaggaaagagaaaagcacagaaagcaagaatattaggggatggaggcacaggcaggatccagagatgcagcagattgggaccctttcgcagccagccagccagaggtgccactcccagatggcagacttctgccttacttctctgccacacctcagtttcctcgtctgttaaacaggcctaataatacctacttcatgggtgtgccatgaagattaaatgggaatacacactaaaatgctgggcacaagtagacattcagtgaggtttgggttttttcctcctgtttcctcttctaactattggaagaaaaatattctacagaattgactgatggtggaggccttttctctacatacacaggggaagtgtaacttatcacttctgtatagtcctcaaatttcttggccccattctgaatttatttccataatcccaaatcaaagtaattgcatatgtaactctaaccagaattgccattgcatgtctgcacttctgcagctaaaaccatgacagattggactagccgcaggaggaggggaacccagtgtacccagtgcaatcatcataagagctgtgaaatggattatttttctttatgccttcatccttagctaaacagagagatagcctgctccatggtgtcaacaaccgcacagcccagattttgcagagaatccacatttgaagtgttacatcctatggtcccttgcaaactgtcagaatgtcctaaaagttctttaccttttctctgagtcagtgacttttatcaatctatggcttttgaattttaattattatgttatatttaataacctcataataatgattattaattttctccacattttagttggaagcaaggtatcattctttcaaccagatgatgaagtagtgggtaagttataggtcatagtcttatttcaagtcgtctgtcttactattgtctcttttttctgtacaattgctaatgtttactgtgaccttgcttcatatacaagtacttacctaagatttggaatttactctcaagtatccattgatgaagagaattgagagtttgatctcaatagcagaacatttacaacttttcagtatttggctataatgggatagaaagagacttccctggtggctcagatggtaaagaatccgcctgcagtgcaggaaacctgggtttgatccctaggttgggactatcccctggaggagggcatggcttcccaccccagtattcttgcctggagaatcccatggacagaggagcctggcaggctgcagtccatgggattgcaaagaatcggatacagctgagcagctgagctcacacaggatagaaaggtggccacagttgttgctgcccttggtgcagcccttcctggacagaagctcggtctataattagactgatgactccagagaaaggaagagtcacaggccatcaacatgaagactactgactgacttggctctgcaggtgctcttttgtccacatccgagtaaattgtatgtagctgctcccttactaccctcgtaaaaccaaaaatttgctgaagacatttattcttttttttttaactctatggttaataccattttgcaaatatatttctttatactgtgtcctagacattcatacacacaactatgaagtagttaagaagtagtttttgaagttgccatttctctgtatatcatgcttgaagctgttaagataaatgtgtaggaaagttttcatcagcttttaacagaattgcctttgatttgagcattttctttgagaatttattatttccgtctttattatctgcccaggagggtgggtaagggacttccctgggggtcccgtggataagagcgcaccttgcaatgcaggggacagcagttcgatccctggtctgggaaggtcccacatgcccaggggcagctgggcccaactgccgcgactaccgaaccctcactctagagcccgcaaccgcaactccaaaggcccatgcaccgcatctaaagagtagcccctactcaccgcaactagagcaagcccgcgcacagcactgaagaccagtgcgcgcacagcactgaagaccagtgcagtgatagataaataaaattttaaaaagaaaaaagaagtcagatgacattgtattattcaagattccgtttgtaagagaccaaaaataaaatccaactggctcaggagaaaatgggattttactggaagcgtactgatgaatcctgtagaaccaaggttagccgtacatcaggggtcagtttaatgaggagcccagatgccacccccatctctgacttggctctgtatgtcagccatcatctctgtcatcactcaggtgaaagaggaagaagaaaaagaaagatgtagtagaggtattatagtgctcatatcagaaaataaactgtccactctgcttctgtatttctgaaatctctccttactagtggtggaagcttcctcaaaattccactgaggaaaatgtagactaatgcttactggcctctcattaggagtgagttcacttttagatagttgcccttatgtttctcattttaattttcaggaattctgcccctggattctgaagaccctggactttgtgaggctgttcgagtccatgagcattacttgggtatgtggttgtgcagtgttttggagctcataagtcttacttcccaggtgtgtgatttttattaacaacacaattgctttgcatctgctgtgagtgtgcctaggaaatagctattgggtggtcgtcatttgactacttctagcttaaattttcggagaaggcaatggcaccccactccagtactcttgcctggaaaatccatggatggaggagcttggtaggctgcagtccatggggtctctaagagtcggacacaactgagcgacttcactctgacttttcactttcatgcattggagaaggaaatggcaacccactccagtgttcttgcctggagaatcccagggaaaggggagcctgatgggctaccatctatggggttgcacagagctggacacaactgaagcgacttagcagcagcagcagcagcagcagcttaaattttcggagaaggcaatggcaccccactccagtactcttgcctggaaaatccatggacggaggagcttggtaggctgcagtccatggggtcgctaagagtcggacacgactgagcgacttccctttcacttttcacgttcatgcactggagaaggaaatggcaacccactccagtgttcttgcctggagaatcccagggacagggaagctgagtgggctgccatctatggggttgcacagagtcggtcacaactgaagcaacttagcagcagcagcagcagcagattaaattttatatctctaaactttattttgaaactgaacagtgttcctacctctatatttcccttacattgttcatggtaagaggtttgaaaagcagtttctcccttggctttgaaattatatcactaatcagaagtttttacttttttttctttgttattaaaattttcatatgtataaaatctagacaatacctgtagtctgagtcaggaaagactcaaaacacttatttttggtttctgttgttaatatcctttggccaatattcaatttaacttaagtgctaattttaaaattttcttatcaggtggccaaagtattggtttcaacttcagcatcagtactcattggaaggaggagtcctcactggaaggactgatgctgaagctgaaactccagtactttggccacctgatgcgaagaaatgactcattggaaaagaccctgatgctggcaaagattgaaggtgggaggagaaggggatgacagaggatgagatggttggatggcatcaccaactcgatggtcatgagtttgagcaagcatcgggagttggtgaaggacagggaggcctggcgtgctgcagtccatggggtcaaaaaaatacacaactgagcaactgaactgaactgaatttacttcttaaatatttaaattaaagtgaataaattatatagacacacaaaacatgctgcatctccttaagaatcaggggaaagcacattaaaaccactgctatgcatccttgagcctgacaaagtcataaagtttgacattccaagtgctggcaaggatgaggagccacagaatcttttgagcactgggagtataaattactagaaatgctttagaaaaattacttggcctgatctaataggtgatgatgtattaacagctcaaacctagtaactctgctggtactttcatgccccagagaggcctgatgtgcaccagtagacatgtgcaagtgtccatgtagcagcatggtttgtcactggaataaaaagagaaaaagcgtcagtgttcatcaccaggaaaatggataatcaaagatatttctaattaactcatcagcaaaagtgtattaaaaaaaaagtgtataagtaacagtcaaacatatcaagatagatgaacctcacaagctgtgctaagtgagaaaagcaagttgcggaagtatacaacagtgtgataccattttatttctataaagttcaaaactacaaaatttaatgaggcatatctcatttaaagatatgaggaacatgtaggggaaaagtcatgtggaagttacctttgtgggcgaggaacgaggatgtgaacacagcatatccacggcctccaatgggagtcttgtttcttcttatgctaggattcatggtttcttcataacttacctataagtcatcgtacattctttcgtattcttgaactatttcattaaattttttcctaagttctttcttgaataatataactggtaatcagactatgtggggccaattttggactcttaaatttgggttttggactattaatagtagtaaatttatatacctcctagcaagtctggtcttccaccaaatcaaaaaactaggttccaaacaactccctgaagatgtcttattaatcttgttgcagaatattaaggatagaggtaaaaaattgaataaattcttccagctcttttgtgctttcaattctcaagccattctgtcaaacataaaaaatttatttgttatacaaacatttcatgcatctcaatataacaacaacaaaaaaaagcccaatcaaaagatgggcagatctaaatatacatttctccagtgacgacatacagatagccaaaaagcacataaaaagatgctcaacattgctaattgttagagaaatgtagatcaaaatttcaatgaggtatcacctcataccagttggcatggccatcattaaaaagtctacaaacaataaatgctggtgacggtgcagagaaaagggaaccctcctgcattgttggtgggaatataagttagtaaaaccactatggagaacaatatggaggctccttaaaaaactaaaaatagaactactctatgatccagcaatcccactcctcagcatatatccagtgaaaaccgtaattcaaaaaggtgcatgcaaccaatgtactttacagcactatttacaatagccaggacatggaagcaacctacgtgtccatcaacagagtaatatcagttcagttcagttcagtcgctcagtcgtgtctgaccctttgcaaccccatgaatctcagcacgccaggcctccctgtccatcaccaactcccagagttcactcagactcacatccatcgagtcagtgatgccatccagccatctcatcctctgtcgtccccttctcctcctgcccccaatccctcccagcatcagagtcttttccaatgagtcaactcttcgcatgaggtagccagagtactggagtttcagctttagcatcattccttccaaagaaatcccagggctgatcttcagaatggactggttggatctccttgcagtccaagggactctcaagagtcttctccaacaccacagttcaaaatcatcaattctttggcgctcagctttcttcacagtccaactctcacatccatacatgaccacaggaaaaaccatagccttgactagatggacctttgttggcaaagtaatgtctctgcttttgaatatgctatctaggttggtcataactttccttccaaggagtaagcgtcttttcatttcatggctgcagtcaccatctgcagtgattttggagccctagtctgacactttccactgtttccccatctgtttcccatgaagtgatgggaccagatgccatgatcttcctcttctgaatgttgaactttaagccaactttttcactctccactttcactttcatcaagaggcttttgagttcctcttcactttctgccataagggtacatatatctgatggaatattactcagccattaaaacagcatgaaataatgctatttgtagctatgtagacagacctggagattatcatactaagtgaagtaagtcacacaaaggaagacaaatattatatcacctatatgtggaatctgaaaaaacacactcacagacttaggaaaaaacttatggttatcaaaggggaaagaaaggtggtgggtgaaatacattaggagtttgggattaacgtatgcacactggtgatggtggtttagtcgctacgtcatgtctgttgtgaccccacagactgtagcccaccaggctcctctgtccatgggattctccaggcaagaatactagagtgggttgccattcccttctccaggggatcttcccgacccaggaatcaaatctgggtctcctgcattgcaggcaaccagctgagctgagggaagtccatcatacatgcacactactacatataaaatagatgatcaagagagacctactgtatagtaaagggagctttatttagtattctctggtgacctacctgggagaagaatctgaacaagaatgggtatgtttatgtttataattgaattcttttctgtacacctgaaactagcacaatgtttgagtcaaatatactccaatataaaataaaaattaaattaaaaaaattggcacacattttcagcattatttcttggacttgtagaaagaattgaaatgataattacaaagaattataatactgttattattgatccatatatggctctctattattaattttcttagtttttataacacaataagtacttgtggaccacctaatacaaaagcaaggatctcaacattaaaccacatctaaccatgtaattttaaagcctctgcaattttaaatgtagttttattagttagcattattttgatctgataaaacttctaaaatgtatttttaattggaggataattgctttacagtgttgtgctggtctctatacctgtgaatcagccacagatatacatgtgtcccctccctcttgaacctcccagcccctcgtccaggttgtcgcagagtgctgggctgagctccctgttgcacagcaacttcccttcagtcgcctgccgtacataacaatggcgtgcgtgtcagcgctgctctgtacattggccccaccctttccttccccctctgtccacaagtctgttctctgtgtctgcgtctgtgtccctgccctgccattttttaagcactacattttttatttcttaatgaaagtataggtagtaccaattcttatgatggaagataatctcaaaaatataagcaagttgtacatagactgaacatgcactgttagagtagatgggctttagagtcagactttcaaacttggactcccctggtggctcagacagtaaagtgtctgcctacaatgcgggagacccgggttttatccctgggtcgggaagatctcctggagaaggaaatggcaacccactccagtgttcttgcctggaaaatcccatggatggaggagcctggtaggctatggtccgtggggttgcaaagagtctggatatgactgagcgacttccccttctttctttctttctttcaaacttgtggcatcagacaaattattaccctgaacgccatttgataatcaggaaaattggggaaattgctgtctcaaatttataaggattaaagtactgtgtgagatatcccttggtgcttagtatattttactgttttaatgccttgctgtctgtctgaacgttttcatcgtgtgcttggatgctttacgtccccactagatggcactggttggccagtttaattctaactgtccaacccgtctgaatcttttgccttaagaggaaaaatacttagggtaaacactattgaaagtgttatacacttgatatcaggtaaaattagaaaggattacctatactgtgaaaaaatcacattaagtatacacattcataaaaacaaaatattaaataattaaacattaaggaacagctttgttgctaagtcacttcagtcatgtccaactctgtgtgaccccatagatggcagcccaccagactccccccgtccctgggatcctccaggcaagaacactggcgtgggttgccatttccttctccaatgcatgaaaacgaaaagtgaaagtgaagtcgctcagtcgtgttcaacttagtgaccccatggactgcagcctaccaggctcctccatccatgggattttccagaatggtcagaaaatatagagctaatgtggcttaaactatattagcagtttacgttttgtttcaagtgcagtagaaaaccattgatgaattttaaagaagtgtgaggatgttatttatgtttttaaaagatcattctgacactgctgcatttcaaagacaccactaaagagattgaaaagagatgccataaagttgaaaataatatttataacacatgagcaagcaaatgacttacctaaaatacactacgaattcctgcaaataaagaagaaaaaagacaacaacaatagaaaaattggtaaaacacctgaacagtcacttcacaaaaggaattctagggcttccctggtggctcagtggtaaagaattcacctgccagttcaggggacacgggttcaatccttgttccgggaagatctcacatgccaaggagcaactaagcccagatggaaaactattgagcttgtgctctagggcccaggaaccacaactactgagcccatgtgctgcgactactgaagctcgagtgccctagagcccgtactcagccacgggagaggccaccgcagtgaggagcccactggccgcaactagagagaacccgaagacccagcacaaccaagaataaataataaagaaataattttttttaaaaaaaggaattctgtatggcccgcaaacatggaaaggtgctcaactacattagtaggtgggggaaagcaaattaaaatcacagtaagaaaccatgacacacccatatgatgggcaaaaatgtttaacaccagggcagacaaggatgttcaaagcagcagctttttgagagtcaattcataagccactgtggaagtgttcagtgatgtcaaaggcagagttccattcctcagtaaacaccctgtagaacacctgtgtatcagcacaggagtacttttatacatgagcactcttagttaagaatgcttaactcccgaaaagttaagaatacctaactaccaaaaaatgggggaaaacagaaatgttccttaactggagagtggataacccattcattctattaaattagatgttgccataagacatcaaaaatgaaaagcatgagagcctagtggcatttccccagctcagtggtaaagaatttgcctgcagtgcaggagatgtaggttctatccctgggtcaggaagatcccctgaagaaggaaatggcaacccactccagtattcttggctggaaaatcccatgaacagcggagcctggctggctacagtccataccgtccaaagagttggacacaactgaagcaacttagcatgcgcagccacaagtaccaaagaaggatgtcttaaaaaatgataagcaaagaaagaagatagaaataaatgtgtataaaaaaaagaagtgtgtatagtacagttccatttagagaaagttcataaacaggcaaaacaaaattatgttaggaatgtatatgcagagttgatggcttttgatcaattgatcaataaagaattaatgcttttgaactgtggtgctggactacaaagagatcaaaccagccaatcctaaaggaagtcaaccctgaatattcattggaaggactgatgctgaagctgaagctcctatactttgaccacctgaagcaaagagccagctcattggaaaagaccctgcctgatgctggaaaagattgagggcaggaggagaagggagcaacagagggtgagatggttggatagcatcactgactcgatggacatgagtctgcataagctctgggagttggtgatggacagggaagcctggtgtgctgcagtccatggggtcacaaagtcagacacagcttggcgattgaacaacaacttgcgtttgttaaactagaatggttgtgacctctgatgtcagttatagctcagttttttaaaaatgcctttggtgggagaggcgaggctgtcaacatgaaggctgtgttttcttcttcaatcagaatggtagttactcgtgtacttgttctatgtttattcatccagctatactttgtttcatgttcttttctgcatgttttacttcaaccataaaacatttttaaaaatgcacactgattcctgcattcacaggggagtgtgcatgggcaaaaatggcagcagagaaagcatgctgctgctgctaagtcgcttcagtcgtgtccgactctgtgcgaccccatggactgcagcccaccaggcttctccatccctgggattctccaggcaagaacactggagtgggttgccatttccttctccaatgcatgaaagtggaaagtgaaagtgaagtcgctcagtcatgtctgactcttagcgaccccatggactgcagcccaccaggctcctccgtccatgggattttctgggcaacagtactggagtggggtgccattgctttctcccagagaaagcatagtggaggtgaaagatcctggagtagaggcttggaccagggccgtggtggcagcagagatggacgcaaacagatccaggaggcaggtctaatgggctttgctaacagattgtttcctcttgttctttgtgatagttcacaaaccagaaaaagtcacgtggacagaagctgctggaaccatccgggatggattacgagtctatacagccctgcattatctttctcatctctcgcctggaaaatccgtgctgataatggacggagcaagtgtaggtattaatagttttgttaaaaaacagaccatcgtatcaatgtatggcaaaaaccactacaatactgtaaagtaattagcctccagttaaaataaataaaatttttttaaaaaagaccaaaataggatacttaggaaattgagaaatgggccatccacttactaatacaatgtattgccagttaactgattcactgatttcctataccaaactcccattttctaaaataagcagcttttatcaatagatgataaaagtgtttagtttcctactgctttgaatctgctattactttaaaaaagcagacaagccatttttattcatgcctgttacacaaaacttgaaatagctcctagaatctttgaagctagaccccaggtctccctgcctattttgtatcatatctctcatacttacacttatgtgattaaggtgcttcatttatagatatatcacacaagatcaaaactgtactaatttaaacatgttatatatatgtagttatatataaacatcatgtttatacatgataaacatcaaaatataaagacactaaaagattacataaaaatctaaaaatgttagattttatatctgactgttgatgaaaatgatttttctttaaaaaaaaaaaaaaaaggcagtcttcgttggcttcagccctgtgtccaacatcaaggtagtaattatttccctgaactaacttacaggtcagcaaaagaatggaacttttgaagtgcttttattttcaaagagaggttgctggacttgtatatgtaccatttaattagcttagtacattatgctgacaaggcccttaatggtgcatttttctctttccaaggtcgtgttctgaattcgacctgcctccatccttgaggttatgtgctacagtcagactagctgggagcctgtagcacacagagcttttccttgaggcagtctatcagagtttccctttctaataagcttgtcctattttttctttgtatcagacaagattttaaaatatactgaagtagcactaaactgttactctttattaaaaaaacaacctagtagatgaattagacacagcctccgccctctctcttgtaaccccattgtgtattcccccacacaggcacttggtacaatagccattcagttagcacaccacagaggagccaaagtgatttcaacagcctgcagccttgaagacaagcagtttcttgaaagatttaggcctcctataggtgagtaatagtactcaacacagacttgaatacataaaattttgaagagatatcatatcaccttgaaaactctatttgtaaaacaaactgcaaaatgccaaatgcgtgtcatttttaaaatgcacttagttcctgtgctaagtccaaggttacttaagtttacattgtaattatttgggtttttctgttgttgttttcttttggccacacagtgtggcacatgggatcttagttccccagggagaggacccatgcccctctgctgtgcaagcactagacccctagcaaagtcccaattactcttcagagttgtttcttctttgccccattatcaacttagtcaagtttgaattaggtgaactttgacacagttcagaaacacctgatacctctttaatttttttagtcaataagtcatatttttgtatcacttttcgtttctcaacctcttttacctggtgatatatacctaaaggggcccacagagaatgagatcgatggatggcatcaccaactcaatggacatgagtctgaggaaactccgggagatggtaaaggatagggaagcctggcatgctgcagttcctggggttgcaaagagttggatacaacttagcgactgaacaacaaatgtccctaaagttgcctgtttcctgtgattcgctggcatgggagatgagccagttaaacagaaacccaggtcacatatagtttaggataaacaggatatggcatcagctggggagctcttgaaaggactgaccctatcccaaaagcaatgaacacgggaaagagaaagaaaatagagattgacaaaatagaatggagatgggaatggaatttagtagactggagttaacagaattaacattggagattaacagatgaagagaaaagcagagtgtaaggcctgcaggagggaaagtaagattcactgggtgttgacatgaatgatagttccttaaatcctcaacaaccctgtgccaagtaactgggaaacagcatctcagaatttagtttttccaaggatgtgccagggtgtgtaccactaggcctggaatgggatttgaacccaggcctgtctaacagtaaagcctgggttatttccatggttatgttatgcttttggcagataaccaagaaatggaaagaaggttgaaacaggcattgagaaaggagggagataagaaaaaagggaaaaaagaagagattgaaaatggaggggaggagcataaatagtactgtggacaaggagcagtttcctcttggttaaccctgcccttccctcctgtctccccacgcccacccccaagacttcagtcagtactggactgactacaccttgaacctgagcagctctgagcagaattctctgtaatgagaaggtattcaaagatacaaaaatgaaatagagatgtatcttcattttccaattcaaattctgaggttttttaaaaaatattttattatatttggttgcatcagctcttagttgtagcatgtgggatctaagcagatccctgatcagggattgaacctggtctccctgctttgggagcagtagtctagccactggaccaccagggaagtccccaaattctgagatcttttagttctcattggcttgttctcttaatacagtgctttaaaacaaccagttaaagttagttttattttcactaactctgcttagaataatcctgttttgttttttcaccttcaggaatttttttgttttgttttggagggcaagtcaggggatgccggtacaggttgggatttctgtgactgagaaaggataaaactgcctgtagtagagaagtaccaaatccagaatagatctttgtacttttgagctctgaactctattaaatctgaacattcttaagaaattgtttaatctttcagttcatatctatataagtacatttgctaaattaagagagtctcagttctggcaaaataccctttagctataaagaacagtcctctgtgtcaacagatcaaccttggaatatgttatctgtagaatgctcatattttaatttattgactataccagtttcttcatcctttcatccttactaacactgggttagatgagtgaaaaacaggataattcagattcaataactgcttcaaccatttaattcatttcagagatgagaaatttatttgcttttcttgctcttgctctgggagctgtgttgatcacatagggaacagtacaatcgcctgacttgctgtcctttgcagctcgagtgatcgatgtttctaacgggaaagcccatgtggctgaaagctgtttagaagaaacaggtggcctcggagtggacattgtcctagatgctggaggtgggcactttactaaatcaggagtctctgtcattttttgtgtgttatggataaatttctgggaaaaaatagaaccaggaagtaattacttacacatttattaagttgaggtcaagagtttaactttttgaattggagcttcttcattttattcccattttaagcaccatcaggagaacatgcttaccttttaaaaaagtatgcatgcgtgcttagttgcttcagtcatgtccgactctgcaaccctatgggctatggcccaccaagctcctctgtccaggcaggaatactggagtgagttcctatgccctcctccatgggatcttcccaactcggggagtgaacccttgtctcacgtctcctgcattagcaggccggttctttactgctgggggcttccctggtggttcagtcggtaaagaacccacctgcaatgcgggagatttgggttcaatccctgggttgggaagatcctctggagaagggaacggctacccactccagtatgctggcctggagaattccatggactctgtagtccatggggtctcaaagagactgagtgactttcactttcacttctttactgatggtgccacctgggaagccctttggcgtctaggcatgggagtttaagtatctctgcaagaaatctggggcctccctggttgtgcttgtagcggttgtgctcagtcactcagtcatgtctgactccttgtgagcagcagcccgccacactcttctgtccatggtattttccaggcaaaaatactggagtggattgctgtctgccagagggcttttcctgacgcaggaattgaacctgtgtctcctgcattggcaggcagattcttcacggctttggaggttcttggattagttcaggtctcagtcagtcacttgtttctgctatgtgtggctgccttctgtgggatggtgagcttctgcagtccctttttggacaatgcagagaatttttttgcattttaccttccttgaacttttgcagtttaaccaatagttatttaacacctaatctctacacacttaggtagtgccactgcaccttaagaagaggtttcataagcctgccaagggattctatttatattttgttagaatttatcttctaagatcataacaaatggagctatggccacagctgtttgttttagccagtattttcaagatttgaaattaactcagaaaaatctttcagtggaagtgaatgtatagttcattaacttttcaaatggacatttcaataattacatcaaagtaggacattcttgaatctatgagttccttactcaggagtcagctttccccagagtattaagctatcaacggtacgattgaaacggtcagacttagtggtgtgtgctgttatcctgtctgattttcaaactgaaagagatgttttatctttagttatctcatttataattaaatctaaagtagattttataaacagttttaatgcaaaagtgtattttaaggggtctgaatatatcgtatgttaccttgttctaagaaaaatgcttccttgttacattaaaagtaaacagaactagtttgaagaataaatttttatcagattactgtaaaatatatgttctctccctctctttctttttaaacaattcttctgtaagtgaggttatatagtaaagatgacgaaccagctgaaaaattacaactactaccacataaacatgatatcatcacccttcttggtgttggaggccactgggtaacaacagaagaaaacctgcaggtattatcagaaacagtaaagcattactattccaccaatagggtataattaacaaagaatgatgcctaagtgttttagcatggtgtggttaaatttgtataaatttttaattatttcctatttttaaagaaatatagcttttattttttttttaactttagctgttggccaagatgttgaaatatagttgaaatatagcagaggagttcatttaatggtttggaaataatgacttctaaattttttaatagtatttcaaataagattttttttcccctagtaacaaacattcatgttgacatatacttagcaaaatatttctatataaaatgacaatttcttaattattcaaattagaatttactctgtgtgtgtgtgtgtgtgtgtagtcttccatttttacatttcttccagttttacatttctcagcaaaattcagggatttttattatggtgatattcacataccagaattctcatgttccagtcttcgatgattttctaacatcctcatgaaaatgactggtgagtagcagctagaaatcacacacacacacacacacacacacacacactggtgagtagcagctaaaaatcacacacacacacacacacactggtgagtagcatctagaaatctcacacacacattcacacactggtgaatagcagcaagaaatctcacacacacacactggtgagtagcagctagaaatcacacacacacacacactggtgagtagcaactagaaatcacacacacacacacacacacacagaaacacagacacccctaataccactttatcacctctggattggccttgcattttgaccttgctgtttcataattttggacaatgaattagaaaagaaattacagtgtacatactgttactaaagtctgtgtgctgattacttgcaatttgggtattacttgtgtaaaaatttttctgacctaagataccaatcattctcctgctattaaactcacaataactgagagttctttgtgtattttatccaagctggatcctccagatagtcattgccttttcctcaagggagcagcagtggctttccttaatgatgaagtttggaatctgtcaaatgtacaacagggaaagtatctttatatcctttttcctaccgatttgaatttctggcttgaaatgtaccttgtattctcatcattaaattctgtaataatggtaatagctagttccgagtgtgtataagtacttatttaaatatgaaaacaaccctgtgaaatttaagtattgttattattcctctgtcacaagtaaagaaacaaggataaaaggttaatacacacccaaggatgcagctggcaagtgccaggacaggaatcacccaagctgtctcgctcgtttctgaatgagaaatcaaactataggagacatggaaaaatttacttcattttaatctggcctcaagaaaatcacaggtcaccttaagagactacatctgtattcctatggcagcactgcacaaaacatttcagaatattcatctacattagagttgggggggtggtgtttttaagaatatcagtgctaggaaatctttatcaaagaaagatggattgattatttttaatggaagtgattcagtaacaaatcaagtgtaaaatagaatcattccattttagtaaaagtaatcaagttttcttgagactctgaaagcagttctgaaagaaaggtccaaacctctttagagcggggtcaatttaagaataaattttgtttctgagatgcctgtcttaaaggcagctgtacctggtaaaatttttaatattaatatattggataaatattaatacattctcgttacttaatagagtataattgtgcatgaagagacttgcatgtctcactgaacatcattatttttatcaaatgcgtattgtatatgcatgctatgtacaaggccagcctcctctaaaatctatggcaagcttatttcagagccttcaattagtatattccatattttgagttttaaagagttcatttcaaaaccagaacatccccttaatgtagtgaatgtgtgtatttaaagtatttttgattaaatattttcctattaaatttagagtaaacttaatttttaactctctaaaagatttaaatttcagctttaaataatgaaatgtccaataacattgtaattctcaagaataccatgggatgttaattatagacactgtattaaaagtaacacaagttagcatgttttgaatcttacatgtctaaaagcaggctggctgcctctgcctgtattacttaattctctcaactgctctcctttcccccacaccgtaagattttaacctctctgacaaacccatggaccaagttaaaatatgacatgtttataagaaatgttaaattttcaaaaatcagaaatacatattttatatatatatacacacatacacacacacacacttacacataccattggcaatttcattaacagaagaaagcgaatttgcagtaacaaagagtgaatcagtattctttaggtcctttaaaaaatatctttaaagtagcttatgtttctgttttctcccttacatttcctaaagtcctgaatcaaactttagtcctcacttgtgcaaacgcccctcagctgcatcacacatgagccagttgatgcttatgatttatatagagatagccttccaattgtgtgattatacatcatagataattctcctgtactatcagttaggcgatggcaccccactccagtactcttgcctggaaaatctcatggacggaggagcctggtgggctgcagtccatggggtcgcaagagttggacacaactgagtgacttcactttgacttttcactttcatgcattggagaaggaaatggcaacccactccagtgttcttgcctggagaatcccagggatgggggagcctggtgggctgccgtctatggggtcgcacagagtcagacataactgaagcgacttagcagcagcagcagcagttatatagactctcagctctaatattagttcaattaaatgactagagtttttaattttatactgtttattcttatttgcatatattagacagagattattaactttcttgcatacatatcatatatcagctagcttaataaatgtgcacctaaagtaagaaatgtaagtgctaaatttttaactaaaataccatatttagcgctaagatgaaaccctgacccattctgttattaataccattcacttgggttaacactagtcattacttaaggagaaacattaggcttctttcatcacttgtcctttgaagttttatgctctattatgtcactctctctctcaaatcacttaccccattttcctggtttagaggtagacttggacagcttatagaatttgttacaaaaataggtgacctgcctagcatcctctgcttatcagatagttttatttactcctttacattatcaccttaacagtcttttccagctacgtatcttaaaagatgtgatggagaagttatcaactggtgtttttaggtatgctaaacaaccaaatcattgttcttgtttatttttctattctccaagagataaaatgggcattcccatttttgtttcagctttctcagtatatttgttgccaccatatgttacattttgcttaaacagctgctgtttaatatttctaaagtgtatcctgtgatacaccagtaagtaattattccctaagatagaactggttcatgagttttctttactgcattccatactgtatcagccccttcgcttatccacatcacccctcccaaagcaatttgaaataacccacaggtagacagaagggaaaagtacaattttttttcagctgaatgtttatcaaaaaagaggaattaaaaaagggaatggagagaatgggtcttttcccctcccaaaatctaaccactcttaatagtggaaatattaatgggcaaattttatttaaagtaatagagctgaactacagcaattgtcaactaccctgctgtgtactctcctcatccttaactagacatttctaataatttcattcttcctcagacctcagttggatgaacccattccactatacgaggcaaaagttaccatggaagttgttcagaaaaatcaaggaagaaagaagcaagttgttcagttttaatgttctctctgacctcagctggatgaaccagttccagtatttgaagccagagcttccttggaaattgttcataaaagtcaaggaacctaaaagcaagttttgtgtttttaagtatattttcctgctgaaacaagatgctcatttatttgaagtatttgaaaagtatctgaaaaaaattatcgtacagacggtcgaagcagttgtaaattttaacatctaaagggaatattctgaaagccttttaaattattgtccttatatatttgcctcttataaattgtttacatgaagaaaaactgtcatcggaatccacactatgtcgacaaaactgttgggagtcttgctatgtcaaaatacttttctgatgaactcctttctcaatacttatcttctttctttaaacatcctttgctgtcgtaatttaatacttggaatatattttcaagtatcaaaggatctagccaagagaaagctaaattttttttttcttcaaatattcattcactccagggtttcctcaggatggaaccagagcaacactaacgcgcccgtgacctctgcagtgtttgcgtgaatggctgcagcggcgatgccggctggggccgctttgggggggtcgggaggggaggcccaggcccctcagcagccctggacgtctccgctgagctccggaagcttaccgaagcggcagctcaagtgtgacgtttcctttcttcctggcgcctcgctgcggacttaaatagcactcggctctcccggcgcgcttcccagctacctagccccgggaggtcaggctggcgcgcccggggaacgtcctgggacacaagcgacagcagcgcatctcccgccgcgggaggaacatggcgtggatgacccgcgcgaacgccccgccgcgcacgcgccgtgagaggctcggggacgggcccgcgcgagggccccatcgcgcacgcgccatgagcggctcgggggcggggtcacgcggaggcggagcccggacgcgcgggaacctcctgccgggctgcccacctcggcctccgccgggcgttatggacctgtctgtacccggctattcgcccagtttcaaaaggccgcccgagacactgcggctccgccggaaaaggggtcggagcctcggcgccgcagagcggcccgagccggcgacccgccgcgccgcccgggcggccgggctgcccctccgccctttcccggcggcgggcagaggcggcggcggcggcccggccggggcccgaaggaaccccttcgcccgcctggacaaccggccgcgggccgcctccgagcctcccgagggcccgccccgcggccagcaggaggcgcctggccgggtgagtgtcctcgcgcctgggagccgaggggactctcgtaacagtccgggggtggattcggccgtgaagtagggctggcgggctctcgcgtcccgggagggaaatgggcgccgagttgaagtcgcccgcggcctcgggttgcccgggggtggggggcggcgtgaagtgcgctccgcgagcggccgcggggcgtgcggggctggcggatcccgaggagcggaccctgcatctcccacgctccagtccggtgcccggcctgcagaccctgggcggccgccacggggtagaagggatgagaggtcagtgggcgtgtggctccgagttgtcctggagccacccggggaaggcccccgtttgaggggaagaatacaggaccctctttcctgcggcattcagtgcgtcccttctcccgccctccaaattattctggatttggaggaatggtgaggattgatcagggggtcagaatttaccccatgatttgtcttactccaaaaccttttgaatcttttgagttgagattattgattattgagttatcagtcgtgcagaccacctgccttcttccccgtgcattttgatggttaaagttcagacacaaagctgaagtgacactctccgtcacactgattcgggctcctgtgaattcctgggcttactgagaaacttgtgtgccaggtgaagctctggaggtttaaagcgaactccagcatcatttagaatttaaaaggaccattttttttcacctcagtttttagattctaatcaagaaaatgatttgctctgggaagagaaggttcctgaaagaacagccattacagaattacaccaggtaatacttttgaaatgtcattagagtgtatatttttataaattcagactgctgagaagcgttttacttggaaaatcgtttaccagagagccctgtgtgatcatttctaccagacttgaaaggaccaccggcatcagccttggtaaaggactttgtatgtagtagtaactgtttatcatggcaccagtgctaaagcagatgtagaggtgaggtttctttttcataggtagtaacaagtccaacgcatcactcagaaccagtgcctccaggcttatcccgagttcccccaagacccagtctcccttccttgcaagtgaatggccttcacgtcagttggaaatagttccccctttcctattatttttaaatagcatcacttaaaagagtcgttttaatgtggagaacagcgactggacagcagacagtttgggggaagtgtttgaggcagcagacgcttcttcaaccagcctgagaggctgatcagaggccaggttccctgcaaggagcagcttagccctggctccagagtttggaagctaaaaagtgcttttgaaaaaatgcttggaagatttgtgctttgacagcagtatcaatagcagattttttaaaattatgatcatgaaaatagtatttctcttgtgactaaactatgtagaagtataataaaaggtgaaaactgcctttccaacactaccaccacccccaacaacaacaattcccactttccagagataccatcactgctaatggtctagtgtagctccttctggacgttttcacagtgtgtaattagtttccagtgttatttattgtacagttcataacattttgagatttcagcaatcatgagcatgtttagtggatgacttctgtagattgaagggttttttccttagtactctactaatttttgtgttctttgttttctaaaagactcctcatgtatcattctccgaatctgatattccaccctcagaaagtactgagttacctgtggactggagcattaaaacacgactccttttcacctcttctcaaccctttacctgggcagatcatttgaaagcccaggaagaggctcaaggtatcatccagcattgcagggcaacagaagttactttgcctcaaagtatacaggtaatcctgtgagaaaatagctatgcattaaagtaacaaatgaagtataaaaagtacttctctgcaaaccgtcagcgatatttccttccattaagtttttctttggacatttaagacacagagacgtgggaaattattttattttccaaatgccgcatccatatactttttaaaatcatactgagtaactgttaaatttacagacctgtcctgagaattactcattgttgcaggcaagaattgtttgaactaaactttttaaggccttttgcgaaaaaaaaattgaaatgaaaagcaattgaggagtaggattgcaaagagattttactggtttcctcatatactgtattctgcattttgtaaatgcgctaactcttacccccttgggcgacagtctgttgtaaatttagtagagttaatgagttctagaaagcttttcaaaaatgtaattaccattactttcaagcagctcagctcaaactaggttaaaagagattaccttggttacctcttttttaatcagtagatcctggtgatttgtaattgggactatcggtttttactggctacttttgaaagagttttgaggcaaaggagttgtatatagtgttatctacatacacgcaccctgccctagggttgagcatcattgtcctcaaggagggtagagacaggcaaatgctcctctctgtgtccaggtgtcctttctgatatgtgggttatcagactgtaattgctggcaaggaagcttttcccgaataatgaactacacttcagcctctgtaactgttgttaacacattgctacagaagaataaatgtttggtatattcaatgtctttttaattaaattctgtgtttctaatggagcaaaaactgtccaatatcatctttggattttaggatcccaaactctccactgagctccgctgtgctttccagcggagcctcatctattggctccaccctgccttgtcttggctgccattgttccctcgtatcggagctgacagaaaaatggctggaaagacaaccccgtggtcaaatgatgaaaccctgcagcatgtgttaatgagtgactggtaagatgaataaaaatttgtgaatcccatagtgaattttcattttagcagtattctttccttatttatgatgtgtaattggacattagtagatggatttctctgtccttctgaattgttttattaaaatattaatgattaactgctggagaagactctttgagagtccattgaacagcgtggagatcaagccagtcaatcctaaaggaaatcaaccctgaatattcttgggaaggactgatgctgaagctccaatacttaggccacctgatgctaagagctggctcattggcaaagaccctgatgctgggaaagattgaaggcataagaagggagcagcagaggatgaattggttagataacatcactgactcaatggatgtgaatttgagtaaactcccgaagatagtgaaggacagggcaacctggcatgcatagtccatggggtcacagagtcagacatgacttagcaactgaaaaacaacagccatgattaccaatttaaactgatttaaattgtttacttttggggaattccctggcagtccactggttagggctcgtagccagagttcagtcctggtcaaagaactgagatcctgcattttgcgtggtacaggccactccctgccaaaaatttttttcctcaaattgtttacttgtttagctcttattcactccttttttcccccctctggctgcattgcaaagcttgtgggatcttagttccccaaccagggttagaacccatgcaccctgcggtggaagccaggagtactaaccgctaggctgacagggaactcccagctcttgttctctctttatgtagttatagaatgcatataagtatttgatgactatatagagacaattctttaatattactttttgttaatggctgtgtcccttctcatcagtagaagctgcttattaaaagtcagcaacctgatatcaacctcaactgctttgtctgaagaaaaaatggcaagcatttaaatgttaaacgctacttgttaaagtatttagaattcatcagtgagtcccatgaccaatttcagtcctttaaaaagccaagttctatgtcatgggaaaaattcagaccattacctgtaataattgtgtttgaaatcaggtgaggatcaagtgatatagaaattttcaatattgagttgacattttaataatgcctaaagaaaaatatttttcttcataggtctgtgagctttacttctctatataacctgctgaagacaaaactttgcccttatttctacgtttgtacctatcagtttactatcctgttccgtgcagcagggttagcaggagatgatgtaatcacggctctcatatctcctacaactagaggtataagagaagctatgaaaaacgaaggtaaaactatacctttaaagtgagaataccaaactgtaaacaccttaaaagttaaaatttgaactgtcttctaacagttgaattatcttctacaacttttatcttgttactttaaaaatgacttcatttcttcactttggtcttttttcttagcatttaattaagttatccgttgtacatagctttaagttacattcccttctctagtctctaaacatatgtcaagctggaaagtcccaatctgaatatactcctgtagaatttcttttatagtacaaattatctacactcttctaataacttgatttttaaactttgtcaacacgttagtagatcatgaagtctgttcagtggacttattcagcacttttttaaaaagtgaaagagtaatgtatactcgatgaaagattaccaaatgcagtaagaatatgtattgtcctgaaccatttgtttaaggagatatatgagtattgtgagctgctgtcaagaaagcatggaaaacactgctttaatgatcaaatgtagaaactcattttcaaatattctctacaagtcaacaagactgttaattctttcagagtatattaaataaaacagagtttcatttttcttttctcatgtaggtattgagttttctctgcctttaataaaagaaaatggccctgagaagaggaaagcgtctggaacaggcttgcgacacggggagtatgtgattaagataaccttttacgtcatccatgtgacttaaggattcaatgtagaggaaacagctttatgaaatgtgaaccctaactaactgtagcaatgtcctagggagcaagccatcagtgatgaggatgaagaagaaagtttttcctggctggaagagatgggtgtccaagataaaattaaaaaaccagacgtgctttctatcaagctgtatcctttcagttactgtttaactcaaattgattttcattgaattcagttagtgagcaatgtaatttttttgtttgttttttttggatgaggatgtaggatcttagttccctgaccagggatcgaacccgtgccccctgtagtggaagttcagagtcctaaacactggaccactagggaattctcttgagcaatgtaatattgactggaagttttcttttactattatcttaaagtatccttaagatcatgttcaaatttaacttgccacatgacattaaaaagcaaacccctaagagcagtaaaacaagaaaaattaaagttttttttaagtaaaaatattctgttttgggtaaatttggggaggggaatggaatggatttttgactagagaagaaattcatttttctaaggaatatcaatttctagcaaattcagatggtcataaagaaattattttgattattaggatgccttataattgcaagagcttccctggtggctcagatggtaaagaatctgcctgcagtcaggagacttgggttcaatccctgggttgagaagattcccctggagaaggaaatggcaacccatttcaatactcatgcctggagaatcccatgaacagcgtagctggcaggctacagtccatggggtcgcaaagagtcggacgtaactgagcaactaacactttcacttcacttttcataattgcagtgaagagaattagcaagagcattttatttggagtagggaaaagggttcctggtgagtcaagattaagataaccactgttactgttggtatgggatttgcatttgtaatttccttgattgtcatgttcaggcgtaaagagatacatgaagtacaaatggatcacagaccagagtctgttgtgttggtgaagggaatgaatacctttacactgctaaattttttgatcaactgtaagagtttaattgctacctcaggtccacaggcaggacttccaccaaccctcttatccccagtagctttccgaggtgccacaatgcaaatgcttaaggtaataaaaaggaaagaaattgtgtactaattgtcatcacctaacttctgaagacatattttccccttttttgataggatgaattcttgtttttttaatagctcagcttctttacaggggctttcctggtagctcagtggtaaagaatctgcctgcaatgcaggagacatgggtttcaatccctgggtcaggaagatcccctggaggaagaaatagcaagccacaccagtattcttgtctgaagaatcccatggacagagctggagggctacagttcatgggatcgtagaatcgtagagtcagacacaactgagtgactaaaccacaacctttttacatggtgcacattttctttcctgcgagtaaaaaaattccttgatataaagttgtttcaaaggaattatatgaactatactaattatttgaaatgttgtatttgaattattgctataggaaaagttgtttaatttcgtctttctgaaccactgaaagaacagagccaaccaagaatgttatgttaaattacattgttgttgtttagtcactaactcgtgtccagctctttgtgaccccatggactatagcctcatcatgctcctctgtccatgagatttttccaggcaagtatactgtgagttggttgccatttccttctccaggggatcttcccgacctagaggtcaaacccacatctcctgccttggcaggtggattctttaccactgagccacgggggaagccccattttcaaattatagtaggtctcaaaaactggatcatggttaagtgaaaacaatctctctccatattgttgaagaaatatgcatgcagttttgatgtcaattacatggtgagtaacagcaacagaacctttttattttgttaatactatgcattgaatgtgctttaataaaccacaaaggataccattactagaagttattttccctagaactagtacttccattgacagtctcataatttggaggagaggatgctggaagctgagaatttctgaacaggtttactcacgaaactttcttgtggtggaccttatgaactacttttgttccctaactgttaaagagaggaatgcccaaatgagaagttattggtcacatttttagctggggacaaaagctaaatggtaccataactttctttaaaattttcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccaaaatctaaccactcttaatagtggaaatattaatgggcaaattttatttaaagtaatagagctgaactacagcaattgtcaactaccctgctgtgtactctcctcatccttaactagacatttctaataatttcattcttcctcagacctcagttggatgaacccattccactatacgaggcaaaagttaccatggaagttgttcagaaaaatcaaggaagaaagaagcaagttgttcagttttaatgttctctctgacctcagctggatgaaccagttccagtatttgaagccagagcttccttggaaattgttcataaaagtcaaggaacctaaaagcaagttttgtgtttttaagtatattttcctgctgaaacaagatgctcatttatttgaagtatttgaaaagtatctgaaaaaaattatcgtacagacggtcgaagcagttgtaaattttaacatctaaagggaatattctgaaagccttttaaattattgtccttatatatttgcctcttataaattgtttacatgaagaaaaactgtcatcggaatccacactatgtcgacaaaactgttgggagtcttgctatgtcaaaatacttttctgatgaactcctttctcaatacttatcttctttctttaaacatcctttgctgtcgtaatttaatacttggaatatattttcaagtatcaaaggatctagccaagagaaagctaaattttttttttcttcaaatattcattcactccagggtttcctcaggatggaaccagagcaacactaacgcgcccgtgacctctgcagtgtttgcgtgaatggctgcagcggcgatgccggctggggccgctttgggggggtcgggaggggaggcccaggcccctcagcagccctggacgtctccgctgagctccggaagcttaccgaagcggcagctcaagtgtgacgtttcctttcttcctggcgcctcgctgcggacttaaatagcactcggctctcccggcgcgcttcccagctacctagccccgggaggtcaggctggcgcgcccggggaacgtcctgggacacaagcgacagcagcgcatctcccgccgcgggaggaacatggcgtggatgacccgcgcgaacgccccgccgcgcacgcgccgtgagaggctcggggacgggcccgcgcgagggccccatcgcgcacgcgccatgagcggctcgggggcggggtcacgcggaggcggagcccggacgcgcgggaacctcctgccgggctgcccacctcggcctccgccgggcgttatggacctgtctgtacccggctattcgcccagtttcaaaaggccgcccgagacactgcggctccgccggaaaaggggtcggagcctcggcgccgcagagcggcccgagccggcgacccgccgcgccgcccgggcggccgggctgcccctccgccctttcccggcggcgggcagaggcggcggcggcggcccggccggggcccgaaggaaccccttcgcccgcctggacaaccggccgcgggccgcctccgagcctcccgagggcccgccccgcggccagcaggaggcgcctggccgggtgagtgtcctcgcgcctgggagccgaggggactctcgtaacagtccgggggtggattcggccgtgaagtagggctggcgggctctcgcgtcccgggagggaaatgggcgccgagttgaagtcgcccgcggcctcgggttgcccgggggtggggggcggcgtgaagtgcgctccgcgagcggccgcggggcgtgcggggctggcggatcccgaggagcggaccctgcatctcccacgctccagtccggtgcccggcctgcagaccctgggcggccgccacggggtagaagggatgagaggtcagtgggcgtgtggctccgagttgtcctggagccacccggggaaggcccccgtttgaggggaagaatacaggaccctctttcctgcggcattcagtgcgtcccttctcccgccctccaaattattctggatttggaggaatggtgaggattgatcagggggtcagaatttaccccatgatttgtcttactccaaaaccttttgaatcttttgagttgagattattgattattgagttatcagtcgtgcagaccacctgccttcttccccgtgcattttgatggttaaagttcagacacaaagctgaagtgacactctccgtcacactgattcgggctcctgtgaattcctgggcttactgagaaacttgtgtgccaggtgaagctctggaggtttaaagcgaactccagcatcatttagaatttaaaaggaccattttttttcacctcagtttttagattctaatcaagaaaatgatttgctctgggaagagaaggttcctgaaagaacagccattacagaattacaccaggtaatacttttgaaatgtcattagagtgtatatttttataaattcagactgctgagaagcgttttacttggaaaatcgtttaccagagagccctgtgtgatcatttctaccagacttgaaaggaccaccggcatcagccttggtaaaggactttgtatgtagtagtaactgtttatcatggcaccagtgctaaagcagatgtagaggtgaggtttctttttcataggtagtaacaagtccaacgcatcactcagaaccagtgcctccaggcttatcccgagttcccccaagacccagtctcccttccttgcaagtgaatggccttcacgtcagttggaaatagttccccctttcctattatttttaaatagcatcacttaaaagagtcgttttaatgtggagaacagcgactggacagcagacagtttgggggaagtgtttgaggcagcagacgcttcttcaaccagcctgagaggctgatcagaggccaggttccctgcaaggagcagcttagccctggctccagagtttggaagctaaaaagtgcttttgaaaaaatgcttggaagatttgtgctttgacagcagtatcaatagcagattttttaaaattatgatcatgaaaatagtatttctcttgtgactaaactatgtagaagtataataaaaggtgaaaactgcctttccaacactaccaccacccccaacaacaacaattcccactttccagagataccatcactgctaatggtctagtgtagctccttctggacgttttcacagtgtgtaattagtttccagtgttatttattgtacagttcataacattttgagatttcagcaatcatgagcatgtttagtggatgacttctgtagattgaagggttttttccttagtactctactaatttttgtgttctttgttttctaaaagactcctcatgtatcattctccgaatctgatattccaccctcagaaagtactgagttacctgtggactggagcattaaaacacgactccttttcacctcttctcaaccctttacctgggcagatcatttgaaagcccaggaagaggctcaaggtatcatccagcattgcagggcaacagaagttactttgcctcaaagtatacaggtaatcctgtgagaaaatagctatgcattaaagtaacaaatgaagtataaaaagtacttctctgcaaaccgtcagcgatatttccttccattaagtttttctttggacatttaagacacagagacgtgggaaattattttattttccaaatgccgcatccatatactttttaaaatcatactgagtaactgttaaatttacagacctgtcctgagaattactcattgttgcaggcaagaattgtttgaactaaactttttaaggccttttgcgaaaaaaaaattgaaatgaaaagcaattgaggagtaggattgcaaagagattttactggtttcctcatatactgtattctgcattttgtaaatgcgctaactcttacccccttgggcgacagtctgttgtaaatttagtagagttaatgagttctagaaagcttttcaaaaatgtaattaccattactttcaagcagctcagctcaaactaggttaaaagagattaccttggttacctcttttttaatcagtagatcctggtgatttgtaattgggactatcggtttttactggctacttttgaaagagttttgaggcaaaggagttgtatatagtgttatctacatacacgcaccctgccctagggttgagcatcattgtcctcaaggagggtagagacaggcaaatgctcctctctgtgtccaggtgtcctttctgatatgtgggttatcagactgtaattgctggcaaggaagcttttcccgaataatgaactacacttcagcctctgtaactgttgttaacacattgctacagaagaataaatgtttggtatattcaatgtctttttaattaaattctgtgtttctaatggagcaaaaactgtccaatatcatctttggattttaggatcccaaactctccactgagctccgctgtgctttccagcggagcctcatctattggctccaccctgccttgtcttggctgccattgttccctcgtatcggagctgacagaaaaatggctggaaagacaaccccgtggtcaaatgatgaaaccctgcagcatgtgttaatgagtgactggtaagatgaataaaaatttgtgaatcccatagtgaattttcattttagcagtattctttccttatttatgatgtgtaattggacattagtagatggatttctctgtccttctgaattgttttattaaaatattaatgattaactgctggagaagactctttgagagtccattgaacagcgtggagatcaagccagtcaatcctaaaggaaatcaaccctgaatattcttgggaaggactgatgctgaagctccaatacttaggccacctgatgctaagagctggctcattggcaaagaccctgatgctgggaaagattgaaggcataagaagggagcagcagaggatgaattggttagataacatcactgactcaatggatgtgaatttgagtaaactcccgaagatagtgaaggacagggcaacctggcatgcatagtccatggggtcacagagtcagacatgacttagcaactgaaaaacaacagccatgattaccaatttaaactgatttaaattgtttacttttggggaattccctggcagtccactggttagggctcgtagccagagttcagtcctggtcaaagaactgagatcctgcattttgcgtggtacaggccactccctgccaaaaatttttttcctcaaattgtttacttgtttagctcttattcactccttttttcccccctctggctgcattgcaaagcttgtgggatcttagttccccaaccagggttagaacccatgcaccctgcggtggaagccaggagtactaaccgctaggctgacagggaactcccagctcttgttctctctttatgtagttatagaatgcatataagtatttgatgactatatagagacaattctttaatattactttttgttaatggctgtgtcccttctcatcagtagaagctgcttattaaaagtcagcaacctgatatcaacctcaactgctttgtctgaagaaaaaatggcaagcatttaaatgttaaacgctacttgttaaagtatttagaattcatcagtgagtcccatgaccaatttcagtcctttaaaaagccaagttctatgtcatgggaaaaattcagaccattacctgtaataattgtgtttgaaatcaggtgaggatcaagtgatatagaaattttcaatattgagttgacattttaataatgcctaaagaaaaatatttttcttcataggtctgtgagctttacttctctatataacctgctgaagacaaaactttgcccttatttctacgtttgtacctatcagtttactatcctgttccgtgcagcagggttagcaggagatgatgtaatcacggctctcatatctcctacaactagaggtataagagaagctatgaaaaacgaaggtaaaactatacctttaaagtgagaataccaaactgtaaacaccttaaaagttaaaatttgaactgtcttctaacagttgaattatcttctacaacttttatcttgttactttaaaaatgacttcatttcttcactttggtcttttttcttagcatttaattaagttatccgttgtacatagctttaagttacattcccttctctagtctctaaacatatgtcaagctggaaagtcccaatctgaatatactcctgtagaatttcttttatagtacaaattatctacactcttctaataacttgatttttaaactttgtcaacacgttagtagatcatgaagtctgttcagtggacttattcagcacttttttaaaaagtgaaagagtaatgtatactcgatgaaagattaccaaatgcagtaagaatatgtattgtcctgaaccatttgtttaaggagatatatgagtattgtgagctgctgtcaagaaagcatggaaaacactgctttaatgatcaaatgtagaaactcattttcaaatattctctacaagtcaacaagactgttaattctttcagagtatattaaataaaacagagtttcatttttcttttctcatgtaggtattgagttttctctgcctttaataaaagaaaatggccctgagaagaggaaagcgtctggaacaggcttgcgacacggggagtatgtgattaagataaccttttacgtcatccatgtgacttaaggattcaatgtagaggaaacagctttatgaaatgtgaaccctaactaactgtagcaatgtcctagggagcaagccatcagtgatgaggatgaagaagaaagtttttcctggctggaagagatgggtgtccaagataaaattaaaaaaccagacgtgctttctatcaagctgtatcctttcagttactgtttaactcaaattgattttcattgaattcagttagtgagcaatgtaatttttttgtttgttttttttggatgaggatgtaggatcttagttccctgaccagggatcgaacccgtgccccctgtagtggaagttcagagtcctaaacactggaccactagggaattctcttgagcaatgtaatattgactggaagttttcttttactattatcttaaagtatccttaagatcatgttcaaatttaacttgccacatgacattaaaaagcaaacccctaagagcagtaaaacaagaaaaattaaagttttttttaagtaaaaatattctgttttgggtaaatttggggaggggaatggaatggatttttgactagagaagaaattcatttttctaaggaatatcaatttctagcaaattcagatggtcataaagaaattattttgattattaggatgccttataattgcaagagcttccctggtggctcagatggtaaagaatctgcctgcagtcaggagacttgggttcaatccctgggttgagaagattcccctggagaaggaaatggcaacccatttcaatactcatgcctggagaatcccatgaacagcgtagctggcaggctacagtccatggggtcgcaaagagtcggacgtaactgagcaactaacactttcacttcacttttcataattgcagtgaagagaattagcaagagcattttatttggagtagggaaaagggttcctggtgagtcaagattaagataaccactgttactgttggtatgggatttgcatttgtaatttccttgattgtcatgttcaggcgtaaagagatacatgaagtacaaatggatcacagaccagagtctgttgtgttggtgaagggaatgaatacctttacactgctaaattttttgatcaactgtaagagtttaattgctacctcaggtccacaggcaggacttccaccaaccctcttatccccagtagctttccgaggtgccacaatgcaaatgcttaaggtaataaaaaggaaagaaattgtgtactaattgtcatcacctaacttctgaagacatattttccccttttttgataggatgaattcttgtttttttaatagctcagcttctttacaggggctttcctggtagctcagtggtaaagaatctgcctgcaatgcaggagacatgggtttcaatccctgggtcaggaagatcccctggaggaagaaatagcaagccacaccagtattcttgtctgaagaatcccatggacagagctggagggctacagttcatgggatcgtagaatcgtagagtcagacacaactgagtgactaaaccacaacctttttacatggtgcacattttctttcctgcgagtaaaaaaattccttgatataaagttgtttcaaaggaattatatgaactatactaattatttgaaatgttgtatttgaattattgctataggaaaagttgtttaatttcgtctttctgaaccactgaaagaacagagccaaccaagaatgttatgttaaattacattgttgttgtttagtcactaactcgtgtccagctctttgtgaccccatggactatagcctcatcatgctcctctgtccatgagatttttccaggcaagtatactgtgagttggttgccatttccttctccaggggatcttcccgacctagaggtcaaacccacatctcctgccttggcaggtggattctttaccactgagccacgggggaagccccattttcaaattatagtaggtctcaaaaactggatcatggttaagtgaaaacaatctctctccatattgttgaagaaatatgcatgcagttttgatgtcaattacatggtgagtaacagcaacagaacctttttattttgttaatactatgcattgaatgtgctttaataaaccacaaaggataccattactagaagttattttccctagaactagtacttccattgacagtctcataatttggaggagaggatgctggaagctgagaatttctgaacaggtttactcacgaaactttcttgtggtggaccttatgaactacttttgttccctaactgttaaagagaggaatgcccaaatgagaagttattggtcacatttttagctggggacaaaagctaaatggtaccataactttctttaaaattttcttgaaggctcgaagtgtgaatgtgaagacacaagctctttctggatacagaaatcagtttagcttggagattacaggccccattatgcctcattctctacactctgtgacgatgctactccagtcttcacagaatgggtcgttttctgcaggactgtatacacatgagccaactgctgtatttaatatctgcccaccaaaggataatgtactggataaggtaagtagacagctggtaaacaaatttagttgtagtcttctcaaactacataaaagtgagtcgttcagtcgtgtgctctttgtgaccccatggaccatacagtccatggaattctctaggccaggatactggagtgttagggtagtgtttataatataacaattaggtattgttaatcaacagtattattcagatcatctgtgtttttattgattttctttatcttggtctactatttgctgggagatagatgtgttagaatccccaactatattcatggaatgcactattttcccctatgagtgagtgagtgaaagtcgctcagtcgtgtccgactcttcacagtcccatgaactatgcagtccatggaattctccaagccagaatactggagtgggtagcctttcccttctccgggggatcttcccagcccagggatcgaacccaggtctcctgcattcgggcagattttttagtaacagagctatcagagaagctctcaaactagacagatggaggaaatcagtcatttgtgatgagccaaactggtgttctcagttattaaactgtactaagtattaattagcaagaggaaaggaaaaatgacttagttttttttgaggagataaattctatgaattcacactgttataggaaacacttactaaagaacttccctaacaaaaggcatgttatttttgtggtcctttcggatgcagaacttaacagtacctgattccttttacaaattattggaacattaataattatggatattatttaacccccatgccttttttctatgtaagtttttcttagatgccagggggaggtgagggagagagctacttggtaagttctacgtgatacagaagttcctagatatgtatcacacactttttaaaaagcctttaattttgaacatataaattcttatttacttataaggccttttaaactttgtatcagtttgccagactgctaaaaataaccaaaattagcatttggggatgctgtcattgtgtagaaattctcagggtgagcttctattgatgatgataaatttgcctttataatcatcaatgaggcatctgtcaaagatcccatggtaattttaaaaactcatcagtgttcagactcatgctttttactgacttccttacaaattttcataggaggctgttcacgaggagcttgccaattgtggattgcaccctaaaactctggaccacctttgtcgaacaccagtactgggaaaattgtccttacggcatgtggaaatgagtgactacatttataattggagatcctgaacaccaaagtaagcctaaaaggaatctgtgaggaaaaaagccttctagcaaggaaattcaagattcttatacatttggctttaaagttcactttggaagttacccaaatgtttagagatattaatctttcacagtaactttttattacatgcactaagtttaagagtaggattaaggttttaaaattttgtttttactctcttgatgaagataaaacttttttaaaacttgaatgaaaactctagatccattaattataaactgggtagaaaaatgagtgtttcaatgcaaatggaaattgaggattagtatcaattatcttgagacactgtgagtaatggcattggggcaaaactaacagttgacttaggagacaactagtctactgggctgactgatggtgcttccacctcagttgtttccctgcctgtttatgattccactgttctcaaatacttgttttaatgcgtgttcattccgattagggtattttgtattccgtatagaatagggtcaagagttgtaaagttcgctcagctgtcatgacaaagcagtacttagtatgttcttgtaggttatttatgtgtgtgtgtatatatatatatacgtatataattcaaattttcttaaataaaagtgtttagaaatcaaaagcattgggtaaagaagtaacagtagtgaagaagtatgtgttcactttgtaatccagaaaataaaacaccacatttattccagagaagtttatatttgggccttaagcttttgaaaataaagtttagagacatagcatatgaataccactgtaatacacatgaaatattctatcagaccctaaaaattaacataaacttaaactttctcatagtcaacaaaatagtggctgggtgccgattttattagataagttggttacagcattttaattatcattttacgtctatctagatgtagctgaaattcaaaatgcacatcaaagtaaaactatatcacaactcaatgccatactaaatgtacttggcctctgcagtaaaattctagtcagacttcatttttgactcccttctcattcatggcccaagtggctctgacagaaacgcaggactttgtgctgatcatcacacaacataccactgtcttttttaataacctctacaaaatttgaaaggggaggtggtggcattagccctgtggaacagatcttgcttgattaactcagtaacactggcccagtatctgtccagcagaacccattgtgaactagtacaaggtgcacagcccttcactgattacaggcaagtgttacagcagccgagccataaggaaggggagttacatcatagtacaaaatacagtataaaagcgttatttttaacattccacactgaagattacggatgccttcgaacaatcgtttggatgttagccacttaaacaaatacatcactaaggtaaacaatataaacataccaaaaccctgtatggttaaatacaatttccatggtacaaaaatcaaagcctggagatgtttgtacagattgcttttttacacaatgtcttaaattgccaaatatttacaacattaaagaggaaatacattttgatgcagagtaaaattatctgaaatgattaatataaaacctcaatctatctacgtgaggcactcctgaagcaagtggcattagccatgaggtcctttggtacaaggcccattgcttgaagaaccacagtagctgctgtggctttagcatgcttcttattagggctggcaaagctgggctggtaagcgcttccatttatcaatacctattcaagaaaaacatacaattgggctggtaagggcttccatttctcaatacctattcaagaaaaacatacaataagaacagcatcaaactttaatatctattagctttgtatttttttttcactaaatgctagaaaaataacttaaagatataaaacccatactatgtgagtcaaattaatctcaaccccaaaagaagcaaatcatttgggaaaagggactgcaaatttaaaagcatgtctccaaattgaagggaaagaaaaaaacctgattaaaaaccactcaattccccatgttccactagaaaaggccaacaaattgttctccagattgtacccacatctttccctccaatattgaaaaaacagggaagcatacttaaatgtttaaaacttctaccactctacccacacatattcacactcccagcccacaacattaaccctgtgattacaaaatgctgatccctcaccctctaacatttaagttatcaaattaacgcaaaaattcatatttaccctaaagagaaaatgtttgcgatgatcagggccactatcatggaccaagagaaattcaggtggttgccaccttctcttattacagatttccatcaaggcagacacaggatgtttgcctgcagaggaaaaaataattaattatctccacacctgtggcaacaaattatgaattcaaggggagggtgggacaagagaaaatgcaaaatcgtactctcacctgatagatctttcattgcagcagagaagtttccggacctcttttgtgctctttctcctactgcaacaagacctttaaaaaaaaaaaatcaacaatcactgaataaatttcaaaacatttaaaattataatatggcaaaacaactactccctctgtaggaatcttaacctcaatccatgccctcaaataaaatattcaacagacactcactactcttgatttctatataaatctgttttgacatttctatacatatatccaaacttcatttatcttattggaaattgtataaaaatattcagaaaaacaatatgtgaatacatatataaattgccataattaacaaccactgctgctgctgctaagtcacttcagtcatgtccaactctgtgcgaccccatagatggaagcccaccaggctcccccatctttaaaaactagtggcaaaaaaaggtggctatttgcaaatgatttctaaagatttctcatcccttaaaaaatgatgctcagattaagaatgctcccccaaattcaaggattttcggccaaaacgaagtgggaaaagtgaaaaaggctctctccatttctttttccagcaaactagccctttctgacttcaaatgtgagatgtactcaagagacgccagccttggcctccctttccaaaaggggcttagctatattactatctatttactgtattactatatttactatctaaaatcaatgctttccatttaggctagggagaattcttcacaaattccgccactatgctttcccaaaactaggccatgctgcacaattccgaaggactattccctagaattatgcaatgtacccacagatgctttctaccaataaactaccctctgttaacaaagaatctattcaacttgtataaaagcagtacaatgtcagtgtgacattcagtttctctctctcaatgttttcactagtactacattatagaattgtgttatttctggcctatttttgagtaacaatataataattcactccaatatggaacagaatggcaacatagttatcttctggatgacaatgtagagattctgatacaaaacatttttatttctattttctttttcacaaaacacttttaaaaatatataatttgattagagctagttgtttcattagcatgacaatttaactgcattaaataacctcaacttaaactatctgatcacgaagataagaaaaatacatttcagttttaaattttctggatttttaaaaaatctggtttaaacaaaatctcatttagctggcagccccgtatgattctacaatggacattattccaagtataaaaatgcagtgttaaagaggaaacgcttgtcagcagttggtctattctccagcctcaacactcaactactgaagtttgataaaaagggacatgcaaaagggtttacaaagtgaagactaaacagaactctaacaggaaatgagaatatgtggaataaaaatcttagaaataataaattctagaaacagaataaatcctagaagcatatgttccctgtcaaaaaaaaaaaaaaaaaggaaatcctactttctaaatatgaaatataattaaaaacctaattaaaaacctactacacataacaaaggctgccttttaccctcaaattagtgtctccacctattacgtgtacaaagctttcaaaacgggttaaacattttattcctaactctgtactttaagaagtgccccagttcagggtcactgacatgagaagaatttatgaatttataatagtaatgaaaccctaaatgttgaaggaggtataataaacattctacaaaaaaaaagaatcaatcttaccttttcgatctgtcttaaaatcaactaggataggttccttatttccttctttgttttttcctaatccttctccttctttccagcccatttttctcatcaaaacggctcccatccctccagttactggggctgctcttaagaactgatcctatccaaagagagaaaggtaaaagatccccagtttatagttagaatctgactacagactcagtgtaactttgtaaagaaagcaagcttactttacttctagatctgttacagcaattaaacgcttctatacttatatacatactgtagtgtgtatgttctaattattttcacataaacataacagtattttaaaagtcaaatacgtcaaatggcagttttaaaacagtggcccttgtgcccccctccaaaaaaaaaaaaaaatagaacactcctgttttcgtccactatttaggttcactggtatctcttcttagcttgcaaaataaaaagaaggcaatgttaaaacagtcaataatattaattgtcccaggtgtacctagttaatgaataaagcccagccatcatttagaaatagtttgaacactgaagaagcatactgttatccaaagctttttcccccattctaccataagtataaatattttacttagaaaatccctatgaagcaaaaagatagcacatacaataccctgtaattaaaccaaactgaatttgaattcttttaaaacctagcttgatgttaaaagacttttaaaaaactccttaaatgtttacatacctaggcctcggtagcagcagtgttgtgaatagtagggctggcactgaccggggcaagaagacagctacaaggatttggccctgaaacaagtttccatacagaggggtgaaagttcacaggttattctgtgaacaatcatctctcttgtatccaacccactgaaccataatttccatcaaagcagcaaaccacttaatgtcgtaagatgcacaacactatatacattagcatggtcaacagtcaattgtttccacacattaagaaataagtgatgcctctttttaaagggcatccatgtatatgtaacaaacgactgaattctactgttgatttttatggtcattttctaaacatttaaaatataatctccaaatcatgtcttgtttccccttgttaccaagtattttacatttacattctctagcaaatgtaagcaaaagtcatttaacttatcaacagagggagtcaaaaattttggtagctctggacacagtataatcatttcctctactgacaagttactactaaattttggttttacacagtagtaaaactgtatccttttccccccccagctatttaattataagctggggagaaaacatgccaatggtatgtgactagacattaagttcaacaaggtgctctgatggaaggaggcagctgtggaggtaaaaacatagccctggttcagttccttatgtggtgcaggccatgcagtgttgatgtacagagagaaaagttagcttgatgcttgggtaccaactgccttgtttctacacacctagaatgacttttacttactttcaggttcatccgcccctcttttccaggaaacactcctaaaaaaaagggcaactgtgcagagtataacacaaatccccaaataacgcaggtttctgtttctgttctctattatcttcaaatgtttctttacaccagggtgtatatacagtttaaacaaaaagctaattaatgtagtaagactacaatagtaaacaatattcatcaggtcatgtccaaatcatttcagaaaataaaggttctttcaaatcaataaccatttgaattttttcttactactaataaaacccattccttttcatgtaagagtatactgcagcaaacaaaaaaagaatatggagaatgctggcattccctatagtccttaacattaagagggtgttgccctacaggaaggcaaggaacactgtatgaatgaacatttgaaaaagttttctaaatgaacaagtagttttgtgatatttgaccacgaagatgaatattatagttgcctaatgactttgtccatgtttttgctcatttttctgagtaaaatgttcctgccttaattgatattagcagcatgtatttttcagcaacacacaaatagaagtttcctgaaagcacttttctgtaattattcaaaaatttggtgtgataaatgaacacatctttatcttgtggtaacttaacaaatatgatctgcatctacattttaaatgatctgccaactgtctacaaggactagcagtcaaaaagaaaaaggaaagcttatgaggaacccattttaatcatttttaaaagttatgtgatgtttagaagtcttcagcaatatatatgtatcagaacttcaatgtacaaatgaagaccagcactttgcaacggaatcacattcttaagtttctacctagtaatgtacatgactatttaattatcatgtgcctaaacactcgtaaaaggttcaagtataactttctgaaatatggagtattcagcttcactattagatagtattaaattaaaataaatttatgtacatttataattattcccaatgaaagccattttcaagcactacatgaatcactttcatattttaaatactgtaattaatccaaatttcctaattttcatctttttttccaacaccaacccctagtaaactacgttcattttttaaccaatctgactatgtactcacagtatatcatacttattagtgcaactattctgctgctccaaaaaaggggggcaggcaaagtaagggtatgctttatattaatttgttaataagatcaccagagataatgctatcaaaattgaaaaaagaaatgttatgagattaaaaggtccaaagcaaccaaaaatctgatttttcagaaaaaatcagctcattcactggcactcagcagttctctattacccatgacattacatcgatcaccaccccgcgaggcagttaagaaggcacttggaaactgaaattccaagtaattacttgccacgatcacaacaggagtcaggagtacagcgccattaagaaaccttcccaatccgttagaccaggcagcctccctgtttcagcactgctatgctgccagtactcctgaaacaaagttccccatcacccatccaaccaagccacatcccttcgccagaacccatttcttcagaaagcccttggtaaccacctaagactcccccaacaatgaggcagccgtaggtggagttcacatgtttcactgcaggaatctgaaaccaggagcacctacatcttcacagcacgaggcgtccgtcctctcccttgcatttacgtcttacatttcctgttttttcacggaatcagtagttctcaaactgaacctgtggatcaccagaggccaccagggcctaaatggtggtccacagataagtcttctccacccccatcccagccaatttcgccacccttcagcaccacccaccccacacttcagccatcctcccccatccttctagtcccctggcaagaccaccacatgcagcgctgacaaggggggctcccaaccacttgctgtaaccaagagctgataaccacatggacctggggctggaggtcacaacaggagtgaggactaggggccaagggcgcttacaggagggacgggcactaaggaaaggggaaagaagggcaaaggaatcaaggaatggaaaaccaagtggcagaaggttcttgggggcactgattcaccaaaaatgaacctgtaataaagtatcccatgatgagaaaaaatctgagaactactgctttgaaatcataagatcagttgtccaacaggaaccgtagaatattctgaacagccgctgagatacactgttagcattcaaaacacagtttaaaaaccacccccacaaaacccaggagcagtaggatataaactgagtggctcttgagccgtatttatacattagccattgtctcagggatcaatccatcttcattgtccatcctggagtatatacacatagcaaatttactcatgaactttagttaaattcactggcttctttatgcatttttaataaaacattttcttaaaatttttaactttgtacatggacacttttatatgtgcatatgttgtgtacctttttaatccaggcttgggcaccagtattggccaactgttcttgtgtcaaaacctgtactcctgtacttcctgtgaactggccgggaatagagttcagctgagcccaggcatcaatctgaagaaaaaaggcctcaattaagtaaaattacttctctcattaaaatgccactggtattaattctctaaatgaaatggtttatttggctcccacaaagactaaataacagacttaaatatttaactttaaaaaatatatatactgaatttactgtatctttaaaactgttttcttaaacattccaaagcagttcagtaactgttcagtggatcccattaataataacaaatttaaaatatatatctaacaactgaaaagcatggctgtgacacttattcttcaaaatatcacacagatacatgaatatatacagaaaattgttcacatggtaaaggatccttgctctccttacatatctcataaatgcataataaatgttgatagcctcaatttttaattactttctcttaagtgttataaatcaatcaagatacatgcttaaaacataatataggaaaccggtcattcaaacactgtaatggttaaaggattagttgtcgctcattcagagtatatttactgaacacctgcaactgtcaggcagtattttctatttgtctgaacatgtacttcctgtctccatatatttaccatagaaagaggatgtatggagcagctgtccactgttaaaaacacagactggattcagactgtctaggttcggatcccagttcccctactaatgttgtgaccttgggcctcacttagccactctttctaaatgcaaactcacaaggctgttatgggtacttagctaatatttttatatatttgattacaaactctatgagggcaggtaattttttctatttttattctctcaaatagttcctgccccatagtatatgacatttactgaataatcaagccccaaatcactttcacttaaacaaagcttgctagataaatgattttcaaagacctacatgtcaacagcatgccagtttacttatgtcacaaccctctagttagtgaaatatcatttagacattaaaaccactacatacccgttcctgagcacgatttaacatgctcatagcttcaaggtcaaatgcattctcgctgagtcttttctgagcaagtgcccgttcactcattgctgtagagatgtccacaggctaagaaagaaaacatagataattatctcaaataaccaaagactccctaaattatgaaaactgctcacatcttttgttgcttcatgtcaaaaaccagttttatataaaattctgtatatacaaatatataaaaatgtgtatatatataattttgtaaagcagggagaagactctaaaaggtaaaataacgttggaaaatagacacggattgtttaaggtaagttacaaagtatcaggcagcagataaactcaatccaaaatccaaatgctttctttttttctactacatcaaactacaatcatagaaagtttcatgaaaaacttaaaaatctctcgccttctctaacaaaataatcattggagttttcattttatcctgcttctcagcacagccctcagaggcaataagcaaggttcttaaataagcaagcagaaaaccactgccatgttaaagaccgttcctttactgatgtctgcatgttttcacatacttgtggtggttcatcaagtctgatacaaagaactcagcttcttcaaagaatatattcattatgtatggttttccattcattagtgtgtgcactgatgatgggagttagactgtctctgtggggtgcacaagtatcaggccggagcacttaaagtatgtctgaaatgccttaggttcgcctcttgagtgctcaggttctacctgtaaaagctgatgctaagcagatgcgacttaactttttcataatatccaggaaaacttcaaggattatctttagaccaaatatcctatttaccaaatttgtggaaggctcaaccataggaggaaaaaaaaatatcaagtatttgatgctgtttagttctaacattattaagagctcaagatgacttgtgtcaactcaccaattcttaatacttgtttttcctctaacactactaaacccattaatattttctagtatctcatccaagaaaattcatttttggagaatggttatctgacatgggaggattttcctaaattcatataaaaagaataactagtagcaactgcatggacgtgacaaatatgaggaagtcggttaaaataaactaacagataagtttttttaaaaagccaaactaaggcaacctgtaatttgactgtatagttaaatatgaaatacttcttttaaaaataagacctatataattaagagtcagtgactattagagaataattctatctcatgcataaggattactaatcttcctttttcctatcttcactattcttagttatcttgctgagtcacctagtatcattcctttagcaaaagtaaaattttcttccacaaggtaccaaaaagtacaggtttctatatatctgccatctttaaatgaaagcagaattaaactgaattcattctgtaatcagactgctcacagatctcattaataaaagatcctaatttcttaattaacttagtaaattatccacactaactggaacatttctggggatatacaggtaaaggcagactgaaacactaaaaaactcagcacgtctacttttcaattctattacaactgtgatcacctgctgtgactttttaagtgggaatccagattactttagatcagaatcacattattttttggccttagatatttcataaacctgtcaggtaagatgtaggtatttcataaacctgtcaggtaagatgatgaagtaatttttggaggcccattaaatatgtgtgaaatactattctttaactttgccagaattactgtgggtttcatactcgtctacaaatctaagcattagggtgtttaggtataaataataggtttttattctaaaaagttgaaattcagagatactacggaaaacgtacctacccaccaccaagccaagctctgatcccacaatttctaactgtaaattagccataaaaatgtagttaagatggctctgaaaattccaacttttctaaaataaaattacttcttcccaactgaaagcaaattaacatacctatctgtgacttcatccttctgaagacactttatatcttcatacttttttctcttttaacctttattaagcaagcaggtaacctaaatacctcatcatttatcctcaggatgaaacttcattcaaatctcagtattttatgttaaattcacatctcactctgaaaggaacttttatttatttaaatagttatttatttaatataacaacattgagatttaatataaatttagataaaattacaactagtttttttcctaaggtaatacaacttcatttattcttcaacaggcttatcaagtaagctgtaagttcgtgtcaaaactttattaacaaatagtaatttgactattaatttcatattcatactttttaatgtgaagaaacatacccaaaataggatcaatcaggattatcttaatctctaaagaatcctcaagagtttatatcaaaaagcatatatccaagttgccaggataactcaggatatgaaataaaaaaccaactataattctcaaaacattaatattcaaagattagaccaaagttctgaatcagtattaaaagactcataaaacatcacagctaccctttagaacagcactgtccaacagaacttttacagtgaaagctaatgagcacttgaaatgtgcctagtgcaattaaagaactgatttctcagtggctcagtgactgctgtattggactgcataggatttgtatgtgtatacataaagcatataactattggagaaggaaaatggcaacccactgctgtcttcttgcctgggaagttccacggacagagaagcctggcaatgtgcagtccattgggtcgttaagaatcatacataactataccactactaccagactataatacatagcagagtttgagtcttaatgttgctcaaaaacagtcaagtgtgaaaggtaccaaaatgatgctaaaagttttagaatgctaaaaagtcggggggtggcgggaattatcttaaaccctgcagaacactattatcaagctatcatcaacaaagcaaatttattttcactagtacacaatagaccttccatgtaatgtgtagtaatattctaggcgtcatgatggggggaaatgttttatttccttctccctagggcttgttctaaaaggtgaaatccacataaaaagagtatcctgaattattattccagttcacacatctataaaaacctgtccaagttatttcatccctctacttcagcaacacaacagattactgtttctgtaacctaaaatgttgtcaggactaataacacactaatataactgacactgtaatatgcatttcacaacctaagttattacctgtgcatcttcatcttccttattttaaaaatccttctaagtcaatttaccttccccctgtgttaacccaactgtttacataaataaaacaattatcttaaataattcttaaaaagtcagtgaaaggctattaaagaactaatgagaattattaaaaggtggtcattcaggtaaggaaaaaatagtacctgtaaaaggcaaattactttctacataagaaattgcagggatctccaattaaacgatgatataaaatgaaatttttaagtaaagagagttaaagaaaaagcacctagcctgcatacaaaacatgatttaaaatatttagcaaaaattaataaaatacaaagtaaatgacaactatataaacaaaagccacactaaatacagaatgcctcaggagttatgtggcttggttttaaaaactcatttatgagtctttttattatttcacataaaattctctagtgtaatttttattacatttaaatgaattacagtaattggaggattagataaaccattaaatggtagagaaattccacattaataacctgggagactctaaagaatgaatgaataaaaaagctgtatgtaatattctcgcactgccaagacctatgtgtttcattttcaattaaaattttcattttaccacaagaactcagttttcttaaacctcaaaaatacagagttcctaaccataagggaattttaggggacatgaaggggaaactttatgccagagactacatttatatcctctacccagtaaggctttgctatctttattaccgagaattaatgcccccaaaggacaagttttaaaatgttttccaacacttttggtttcattgtttataaatcaaaattcacacaaatatgatcaaggttctgcagtcactctttactgaggatgatgctggttggcttctgggtaggaagacgatgctatggcagcagagcccacagtgtgatgagttggtatttccataagatatagagttatgttgatccatccacgtctatccactctcacttatgtcaaagagcactcatgtgcacaactggtaggattaaggatcatatagcaaagctgagatcaaatctgtgatctttgcctgaatgttttatgctcaaaactaaagaatcacaaattccaattttattaaaatgaaaaaataacagaaaaattcaaagcactattcaattaaaatattgaccatttaaaaagaactttcttttctatataaaatctttatttcaacccctgacagggaatcaagactcaatgctcccataaaatgtcaccaatagtattctacaaacatttagaatatagaacattaatcttactaatatatttgtaagatacagctaaataactagaactaaacatttcatacagtgaacacttcctttagatgttcaatattacttctaggtaaaagtacacagacctaaaaacaaaagcaaactgctgtcccttcataaaatttggggattgttttacttgaaattaaagttaacacatattttttagtctaactgtctaagaaactagcttagagttctgatagcaatagctgtatgtaatatcccccacaggagaaatctgcttcatgaacagaacttttgtctcctgctttaataaaaggctccttttacttattttataaaatcttaatacccacctactcccctctcccagatgtctttggagttaattcccccaacttttcattcaaatttgacaaccactattgatgacagacaacttaaggcaccacagtttcagtgttaagactgaaaacggctaaatacggtaatatatatacacacgcacacatttatatatactcttaatcaaaaagaaccgtaatcaccaggattcactaagcatcttccccatgttccactgaagttaaatagttatagtcacttatcttcccaggaaaatcttttggaattatgcaatatttatagggctttaccacgttggaaaatttttttcacataaatgtctcgtttttttctaactctgttaaatgcttaatgtttaagaaatgactaaaagcatgtgtattagaatttctaagtcagtcagttcagccctcttaccatggtttatactcagctattactagattcaagtcagttataaatgtcagttaacctttccctcttgagatgtgcagtaagtagcctgatttgcgaatcagcaactgaactactcaactggcttcactaaaaattgtccaaataagctgtctctccttcactggtgatggcgtaccttgcttcagttgttgaacctcatgtaagtatcaacagtgactgtaagttgcactggctaattatgtccagtgtcattgcacagactgtgctcttttccaaatgccacaggtcaaaaacaaaacaaaaaaaaacaatgtctcttgtgaagagctcaggggaaaaaaatactaccaaagtttctgatttgggttctgttcacttttaactttataaacagaatttgtttatttgtattatcagaggtgtttattggatgatgataatatggtcaataaggggaacctgtaggtgaagagtacaggtctctctggatccacatatcccaaaatggcaaggataggaaccggggaagaatccctacactgtacgggcatcagatatctagtctagtccttggacaaaatgtctgggttttggaaaccaagggcaagaggtgatgactagtctattgtatcatttaaaactcccacccccctagtaagtctccaccctcccagatcccccaagcgtgattttgcacaacaagttaaataaaagtaaactgtttattaaaagatacagcaaaggtacagatacagagatacatacaaagatacagatatatatatatatatatttacatatatatacagtctcgctgttttcatgtgcactatatttagcagcacattatttaatcaggcggcattttaatggggctgttttgacacttggcattattactgcgtcattttgacaagatacaactatagcctcctggaaatttcaaggtgtgaattccacttctccaacttttaatagtagcaaaaaggggaaggagaagggaaatgaagtaccaaggctgagcattaggttaaacacaagaattcaaaagggccaaggtagcacacagaaggggaaaatgattaaaattaaaggctatctgacaaacaacccagagaaatatagtaagaaaccattatttaaagggcaacaggctatgtatccgagatgctcacatcagcctacagggaccttttccaatccagttcttgtgttgaacctgaggatctgcctctctctgctcaaatccctccacccaataaatttgctaccaccaaaatctagagctatagagccttgaagcaaaacgggaagctaaatagttgtaccttgggctaccttcccacaagtgcaaggagggcccaatgttgggtagggatgtgataacactgttctctgcaattcgatgcttttcactttgtggcttggttccacaaagtgaattgcatcgagttactgtcaaatgagaagctgcgggttgtttcatctgtcgtctaacccggccctgccgtttaacccggccctaagaagagtgaaacagaatccaaatcagatataaaataacaataaaatgcaggttcaggtatataaaaagaaaaatacataatagtcctcttacttacctcagagggcaaattgctgctgaaaacattatcatcatctttgttttcttcaccgtttttctctacagggacccactctccataaacactatctgcttcttttttccgatgttgcgatccagatgatacagggaattcttttgttaatgttacctggctttttggtggagttggctttgctgcagcaatctaaaaacataatgtttttcttaattcaagaatgtttttcttaattcaaaattcaatagattttcaacataatcggaaaatgactatttctcacagtatttaacctaaattcaaaactaaatattatttcagttttacttaaatagttctacaagttgtgctgttttaccagttcaaaaacattaatactcacattcagattgaaaaaaatgggtttgggttcactgagtttaaagggatgatgataaaaaggaggttcttcttcctcttcatccgaaacatgcggcttattcactattacatcatcatcttctttactctgtgcaatctgtttgcatttcttaaaaagtaaaaacaaacaaaagataaaccttacactttatgtagaataacacataatttcttaaattcaaaaccacataaaatttatagctgggtaacttagctcactacttatttaaacacactctagctggtcagtcagttaacaacatttattgagcacctactatgtgcagagcactgtactgggcactgtccagggaatacaaaaaaataaaagacatggtccctgctctcaaggagcttacaatctagttcaaaagacggaatacatacacatgagataattgaggaacgcttttacagagcaacacagtttaacaagtgcaaactgatataatacaaactgagtacataagtgctcaaagaacaaaagcttaagagagaacagaatcaggcagaatctgataatcaaggaatattccttgaaagttctaagccagattttcatagttaagaaaaaggattagcagggaaaggaaaagaaagtcactctatagtcaggtagtggtaaagaggtgagaaaaaacttattaaaagggataagagggctgaagatgaggctaaaatatatagggaatcactaagtgttcataaggttttggataaggagcttggatttgataagcaagcaatagaagtcttcactaggtccttaaacataaaaaaaaaaaaaaagttgtaattcatattgtaataaatctaaggaaagagattaagaaactatgcaatccccaaatgtatggctaaacaaaatttgaaacacttgcaactgggctagataatagcatgtctttccataaatgttttataggttgagtgtctaaaggaacagaactcaaggatggaatataaggcatgatggagagggtgcaatgatgaggtctgacacataaagcaaagtcaattcctccttgagaagcaaaggaacagactcccattacctggctttataaaaaggtcagagtaaatttgggtggacttgtctctatacaagcagtagaatttatcatatcccttatcaattgaaaatattttaatcagataaaaagctcatttagccaaaaacacagagtataccaagcttgtaaccaaggggaacagaatatattgacagtggcaggctggcataaggctagccaataacaagtttcaatatctgaaacagtgtggtatttctggatcctagcagcaatatttcagcgtcctccaaaaaaaaaaaaaaaaaaaaaaaaaccaaacaaattttaataaaacaaagccataagacaaaaaaaaagcctcaattgaaaagatcaaattcttaaaaacaaaaataattgtgtttaaaatatatatgttactgccaaaacccgaaccgcaggaagaactgataatggccggccattatcaccaatggctggtaccaaacagccaaaacccgaaatgttgatgcgaaagaagttcctttcaggcaatggccagctattctcattaatttccaagctccggtggcaaaagatcatttctgaagattgtctgtgtctttgcgtatatgcagtacactcgtggcgatcagtgaacgcgtcgtgaatggaaacgaaactgtaggcgagcttctgcgtgttgctcactcaacacctcctccattcaaacgaaccgtcccactcctcagtcagtttggcttctaaaactggaaagcaaaagtaatgggaagtaacttagctagcggagcttagccatcccggataatggcctgctaaacagagcttctgccgctgccacgtctgtatttcgggttttggccactcggtgccagccattatcagttcagcccacaattcaggtttttggcacgctccagagtcaacatcactggagtaatccatttaagaatgaaaacaaattctgtctagcttacctcagttagttcttctatagtagctcctcctgactttttagcaactttctcttctattgtaggtgggggtgcaggctttaggtttggtggtaaaggaacaccagccttagcacacatggcagctgcattagctttggctatttcaagtaactgagccttatctgcaagaggaaaaatacaaaaagcagttttcctgaaaggctatacattttatattatctaatgttttacatgctaaaaaaattaaaggcatcaattttctgcccaaacttacagctgtgatgaaatcattctttggctcaaagatttaaagaaataaagaaaatgccccatatttaaaagtgaattaagtccgtatttagcttcccactcaaacactatacaaaatagctaaactacacaactacaataatcaccctgctatacatgctaactcccacacctgccaaagcctactttattttccaaaactatggtgccccttaaattactctccttctaaatctcttaataacattctaaatcactctttgagcccaatttcaaaactgccaccatttcaaagtaacaagtcttaagtcagaatttaacattcctctccattgtgctcccgaagtacctaatctgtaccagtatttacagcaatcatcacattctgctcttaggcagtttcactacttggtaaaatagacatacatgcattttatctgtgtctcttgtactagctggtaatctttatgttttttaataaaaaaaagcactcaaaaaccatctgttaaactgaatcattctcccctaaggttctgtctaggactttttcttttgactagtctgacctggaaatgtccaatctactgggataatgacaaattatccattaacagtagtcatacattatccatcaaattttagtcacctctgctcacttaaaaaagcaggagatattagaacacttcattttgtaaaagacagacagactgaaatcactaactccccacatgcaaaattccctactcacttacattacccattataccaattagaattatcctcacaaacatttaacagttctatatgccattttaagacatgtaactatttaaaaaagaaatgtctgatttcaggcttatttgcaagaacctatgttggaataattacagtaacaacacctaattgaacttctacttgccatttttagttatggtatatggttcaagcagaaagaaaacattaaagtatggaaatactttggttctaatatactccaaagctaatcttttaaagctaattataaatatacttattcccacattttctaaacagaagctaattacaaaaacttaaagatagaaatatttaccctcaaaaaccaataatccccaatatgtcattaaactcacagaaaaaaattcagattcaaatcattctttaatactattaaatatttaaatgactcactcaaatctgtgagacgtttaggtgatctgcctctttctgaagacctggatcgtttgcgacggattggagacctgctaaaccttcttctcaagggtgttcgtgatcgccgtaatctgactggtgatatactgaagcttcgtcttcttaccacagatcttgatcttctccgacgactcggggtccggctccgtcgactcggggtccggctccgtctgctaggggtgcggctccttcggcttggggtgcggctccttcggcttggggtgcggctccgtcggcttggggtgcggctccgtcggctaggggaaatgctaaagctccttctccccccggatctggatcttctcctacgactcggagtatgactccggctccgacgacttggggtgcgacttcgagctctacctgttttccggttatccctggagcttgatctttttctttttctttccctggacttggatctgtgcttcggagatcttttgcgcttctcttttgatacagatcgccttcccctggactttgatcttgacctgctgctcctcctcctgcgtcttgatcgtgaccgcgaacgtgtttgagagcgatgagacttggacttagatgatctcttccttgccctagaacgagattcactggtgcgttttcgagatttgtgttcagaagacttggaacgtttacttctcgaccttaatgaagagtctcttttcttctctttctcgcctttgtcacggttcttatttttcttgcttttttcatgtgtgtccttaacctttacaaaaatttcataatcatctttttcctctgaagacgactctgaagctttttctggtatactaattacaactggactggcagcagatttatcccgttccacctcactcggaagtaaaggtccttcaataccagctctaaggtttgtaagacgttccatgtctttaggaagtaatggtctcactaaatcagcttcattaatatcatcaatgctggcaggaaatcctgaatcagacaatatctctttagtagtgagagatacttctttatcttctccactactttctttaggactgatagcagctgctaacatctggtcactctcctgtacaggtaatgatccttctgcatccttgttgataaaattattagataaatcaggatgaatgtcttgagcaggcaaaggtccctctatgtcagcttcactgccaccactgggactggtggaaattaccatgtcatgttcagtatcttgagtagttaaagatacttcaccatcatatttactaactgaactgagagcagatgctgtgccaaattcaagatccttaccagttcccactgcttcagattcaaggacaaggggaccaacagaagacagagttcctcctagctcagtttcactaacactaggacaggtatccaatactgtgcattgtttagtctcactggtaggcaaaactgcctcttcacccatttcaccaatagcaccagtgctggcagcagacactgtgctacattccatctcttgagcaattaagtgattatttatgttaaggtctgtacttatacaattttcagtttcattagagccactcttcaggagtccttcagcacgtggctcttcctctgaatgcatggctatctcctgcaggccaatctctgaagcaatactttgatcaccagatagtaaattcattccttttataacactagattctaatattactgctgtagactctacaactgtctcagctggtattacttgagtttgctctgagacagtgacaggaggctctgaaattgtcacagtggactcttggacacaactagatggttctgaaacaatcacattaggttgaaggatggacaccactggttccagaataggcacagtaggctccagggtagagacaactggcacagcaacagtaacatgctctggctcagacaaggccaggggctctggtacagcctcagctggtgggtccaggacagccacagctggagggtcctggacagctgcagctggagggtctaggacagcctcagcctgtggctctgggacagccacggttgatgtctctgaaacaatcccagctgggtgctctggaacagccatggctggcagatctacagtgctctgtgatggctctgcaataggtactgctggctccagcagagacatagatacctctgaggcagtctgtcctgaagccctcatggaatcataagtttctgctgtctctgatataacagaaggctctgatgttaacacagttggttcagctgatgttgtgggagtttcagacaccatgtaagtcactggtctctctgcaaccatttcatgctcttctgctccagcagcagactctacaggtgttgacataactgaagactctggctctagctgtggttctggaacagtcacgtcagcctctgatgctaacactgaaggctccgatgctgacactgaataattagcagtcactgccaaaggctccgcaatctcactttgactcacaggaggttcaggcagcgatacagactcttcaggagctaatgctggcacctcagcagaccatgtattttcagctgttaatgctgactgctcagcggctaacactggaccctctggtggttcctcaggaggcaatggtggtgtcattggtggctcttcaggtggcaatggtggcattgttggaggctcttcaggaggcaaaggtggcaccatatatgcctccgtgtatgtatcagtataagaatcggtgtaagaatcagctgccatagacatcattgaacgatcagcagtataagatgacatcatagatcggtcagctgcagagtacgatgacatcatagaccggtcagcagcagagtacgatgacatcatagaccggtcagcacccatggacatcatagatcggtcagccattggggacatcatggagcgctcgtaggctgacatcatagagcgttcataagctgacatcatagagcgctcagccataggggacatcatagagcgctcataggctgacatcatagagcgctcgtaggcggacatcatagaacgctcagccataggggacatcatagaccgctcataagacatcatagagcgttcataagatgacatcatggaacgttctgcagcataggacatcatcatagaacgtctagatgctaacatcaggggtctaggtgctaacctatatggcctgggagctattctataggacctgggtgctatcctatagggtctaggtgacattctatagggatcaggagttagtctgtagggatcatggcctaatctatagggatcctgccctaacctgtaggcatcatgacctagcctgtaagggtcatgacctaacctatacggatcctgagctaacctgtaaggatcctgagctaacctgtagggatcaggagattttgaacccaacatagcagaatcttgggtactagatgctaacatctgggcatccatggtaccagacgctaacatctgagcatccatggagccagaagctaacatctgagagtccatagtgccagatgctaacatctgggagtccatagagctagtggctaacatctgggagtccatggtgctggttgctaacatctgggagtccatggagctggttgctaacatctgggagtccatggagctggttgctaacatctgggagtccatggagctggttgctaacatctgggagtccatggagctggttgctaacatctgagagtccatggagctggttgctagcatctgagagtccatggagctggttgctaacatctgagagtccatggagctggttgctaacatctgggagtccatggagctggttgctaacatctgggagtccatggtgctagaggctaacatctgggagtccatagtgttggatgctagcatttgagagtccatggtgttggacgctagcatttgggagtccatggtgttggatgctaacatatgggtctccatggtgttagaagctaacatatgggattcttgggccatcaagggatccactcctactgttacagaagtctcccccactaatgtagtaggcagctcctgtgctaccgtattataggattccagcgctgtcgtcgagggcacctccagggactgcgacacggtcatcgttgacagctccgttgtcaccacagactgaacagagatctccagcgccacagttgccacaggctgcccaggcaactctggcgccccaggttgccctggcaactccagcacccctgttgccaagggctgccccagaagctccagtgctccagctgccccagactgccccgagaactccagtgccccagctgccatgagctgcccaggcaactccagtgccccagttgccacaggttgccccgacaactccagcgccctagttgccgaaggcagccctggcaactctggcaccccagtcaccgaaggctgccctgacaactccagcgctgtcgttgccaccggctgtcccggcaactccagcaccattgccgcctcaggctgccccagcaaccctgttgccgttgtcacctcaggctgcccaggatgttccaccgctgtcatccccacaggctgctccaattctgtcgtcgtcacaggttgttcggtcaactccattgctactgttaccacaggctgccctggcaactctactgctgttgtcactgcaggcagccctggcaactcctgtgccatcacaggtggctctggtacctcctgtggtggctccaaccccatggatggtgctggaagccctgacaattcctgtgacaactgtggcactgatgtcacagagggccccgccaactcgggcactgctgtcgcagggggccctagcaactcaggcactggggtagaaaggggccctggcaactctggcgccggggtagcagagggcccaggtaactccagcactggagtcacagggggcccctgcaactccggcatggaggtcgcaggtggccccggcaactccatcactgaggccaccgacgactcctgcagctccaacgctgtggtcttgggcagctccagcatctcctgcggtcgtgtcatggatgaatctgcaatctctgacggtccttctacaggctgctctggcaatcttagcacttcagttgctgacgactctggaaaatccattgctgttgacgtgcttggctcagggtgcacctcagtaggtgtctctgatgacacaagagtttctgatagctctagcacttttgctactggaggctctagcaacatgatctttgatggctctggaggtgtgctctccaaagatttctgcacagatttcatctgacactccactgacactgttaccactggctcagatgactttagcactactgttgttgtaggcactggtgctgttgcaaaggaatccagaatctttgttgtggatggttccagcattactgccacagactgctctgacggcattgagactactgacgtagatgcaactgacagttctgtatgttttgtagctggcgtcaaagtttctaagatgtgtggctctgagacctccatcgaaactacaggaggttcaagcacaactgcaggagattcactggtatcatacaggccaaatgctcttacagaatgctccagtgccatctctgaaggttcagaatcaaacttcaaaaaggaatccgactctatgttcccatcatgatgtgatttcggctttgactcggattcttctgactgtcttttatactttttctccttttctttcttctttttcttctttttatttttgtgctttttatgcttcttcgactttttggtaggaatttcatcagtaggatctgtttggacagacacacatctactttttctggatgcctccttcaagtctaaaattaaagaaaattaattatgtcaaatattccccaagacagatttagataaatcatataaacaataccttacattccatgttaaagataccataagacatttcctgttaaataattttccataaaccagctatatgaagactggcacctttgcaacacttctacaactaaagccagggttaaaaataagttcttaatttattataaaagttcttagaattacattaaaatgtatttttcctaagttcatctaaaacaattattttctccagctctcaatatacaacttttaaactacacttacatataaacatctttcatattgttaactatcagaattcctaaaaatacatatactgaataatttttgtgactatttcgtaactcctatttactcattcaagaagcaatgtggcactggctttagaacagactgtctgcttttgcatactgaatcaatgcaccactcaattgctgacactgtctttcagaggcagaggacaaactgagttaaaacatgcaaagtacactgaataacgcgtggcatcaagtaaactctcagcaaatgctgctgctgctgctgctaaatcgcttcagtcgtgtccgactctgtgcgaccccacagacagcagcccaccaggctcccccgtccctgggattctccaggcaagaacactggagtgggttgccatttccttctccaatgcatgaaagtgaaaagtgaaagtgaagtcgctcagtgctagggaacgcttttataaagatggcaaaggtctgagcaacaaacacaaaacatggaacctaaatcactcatgctgtattctaagaaaagtaacacctcttcccttctcttctaaagttactaagaagttaatttacaacccttaagaggttaagaacatttctgcatatctaaaccaaaatatggtgtacactttattactagatgagatttattctaatgccagtataaaatctgataaaccttagtgatctcagaaaaagatcagaaatccaggtcatcaagattacggaaaaagtgaattaacacaagacaagatctgtttcaaaacaaaactaatcattttctactaattgtttatattatgtaccaaatctacattatacttcaacaaaagttgctcaagtcatgaatctaagcatggccagtctatactattttttttaagccatactccgtattaaaaaaaaaaaaaatccataaaatgtctccatttccaaaactaaaagatggttgatgataagacatttctaagcaccaattatttaatcagttccccacatgctcaatatccagcaatgcttcctccccatttattatacctttaaaagtagatgcaaaaacaaagtaatctctaaccttgagttttaaattaaactttccagggttttaaaatcattacaatttggtccagactcctgtaccttccaaaacttgacacttacacaatttttcaatgaaaatccatattcaaaatcctggcactgaggcactacaaatctaatacagttacattctaccagtaaagcaaacaactgcaattgtattttcaaaaaatggacataaacaaaaacaagtcttcagtaaatcagttaaattaaaaattcaacttactgacactttagatctaatgaacatcttaaataccgtgcaatcagaaatactattatttaactattaactatttttaaaaatttagctttcaagacaggtaattatcttcaacttacctggcttatatcgtaattctgtatctaagaccccagaaagtacttcctctatcttctgaactatgtcttcatttggtaggttcctggcagaggcagctgcatcacctgcctggtttccttcaataggtgtgtttgtttcaccattgagctgtccttcactccttccacttgacaagaaaagttatcaaaatttgttaattctatcatgacatataaatatttgtaacaatttatttaaaaaaacctcatattattcatacatttcaccattttgtatttaattttggatgatattccccttttccccatcaacagtgcttccttaacactacttaacagttggcacatttttattttcatacaatttcttaaagttttcagaagtgttaaagttaaaaaaaatctttaaaacaggtttccaagctcttttaaaaaaaaacaaaaaactaaatactccccaaccagcatatttctctcaggggaaaaaaattactaagatcacaataacaaaaccaaagaagaaaaacacattacctaacgttatggtaaatgctatagtgacaataaagctacacctctggatggatcacaatcaccatcagcaatatgaagtaacaaaaatttagccacagacatttagtcaaaagtataactggtagcttcagatcaggttgagactcttcagttactgaaatgccataatattgaaaagaaaaaatacatttatatagttttcacccagttaccaaaaatcatgtaaaccaactcatttataataagagtaaatgaatgaatcacttaacatattttcaattcataggaacagaagaatcttgacagaagatacattttaatatatcacttatttttatcatttgccacttgtattattttgtacaaatttacaaaattgtttagaaaactattttcacaacagcatgtgtgacttactgtaacttaagctttaactaacaaaaaaattcagtagcttttcatgatattaaagaatatttggttttctaatacaatgaatcatacaataaatattaacatttattaattattaattagggtcacatggttctacatttctaaactcatttatccccacaaactctgaaatcagcactactgttctgatttttcaatgaggaaaatgaggcccaaagaaaacaaaacaacaaaaaaacctagctgaaggttacacatctattaagcagtaaagctggcattcaaaaccagagctcttactcctaaccatctacatataaaaacttcactcaaaccaatatacataaaaaaataaatgacacacacagaaaaactacagctcactaaaatagcaaataatcttgacactgatactgtataaagttacttgaaaagaagctttttactcctctagtaataaactgctttatctaattttctttttagactttcttcctggactttctttacatttttcctaagcacttaccctgtgcttatcttactaaaaaatctacggatttaaaaatcagaaaagtaggtataaaaaacaaaacaaaaccaggcagtctataagaaagtaatcatcttaaagctatccggatgttcattcaactactgaaaaagggtggaaatttcaaggcacctaaatatcaatacaatcctacaataaacagaattctgtggagcccgaaaaaatgttccaaagcctactgaaaccatgataaaagttcacaatatacaggtgaaaaaaaaaccaaacaaacacaaaacaagatgatcacatttcacaaaacacgtgcatctgtatggacaagaaaaaaaagttaaagaacataaagatcaataaccatgtcttttaaaattcgtttctctattttttctaaactttctacgacaataaaacttctaatacaaaacctaatttttgaaaagtacagaaacaagacattacaattaccaaacacaactacttattgcatgcaactattaaaaagtttccaggaaaattatattcccttagctcaggtcgtttctcaccatcctaaaaataacaaaatttcaaaaagcaactaaatcaatgaacagatatatttcccacttaaaaaacaaggtatacgcaaagaattccagcaaatctctatcactgccccacaacctcacgttaattggagcgttaagtttacaactgagtttccggctaattttcaaattcacctcacgcctgattctagctctcaacttttaaaacacaactaacaatgcatttaactgggaacaaatgtttacgttacacaaaataaaaatacaaaaagacaaccactaaataacatgacccacgcgattttccttcctgagtaagcaactatttctttgcaagtctcttcccattcaaattgtgtggaaccaagggtaaactagtagcgatgacaaaaacagcatgttggtcaaatatgtcaattggggcagagggagcaagaatatttagaccagtacacgaactccactttccacttgctaaatttagtaattactagtaattcaaagtttccttccatcttcgcctcgaatattctgtcaaaatagctaacgttaactcgaactgctttaatttaaatttctaatctaccagactatttaaaatgctacctggtggaagccacaggacattaggacccaaatcatcttctcaaaggatcccgacccccaaatggtccgaagcttgcaataataaagcgtatttaagattattcaagaaacggccgttagacccctttccggtcaaagacaccggccggcgaaatccgcggaggcggagagggggaggggaagcgcggcggcagagctgaggaaggaactaggcccatccctggtggacaagcaggcctacagtagctagacggtaggggatgcccaaacaggagagaaggctgagcatcttaagtcggttctagaagagagagcctgggattacctcggaaagggcgaagttcctcgccgggaagggagggagcggatgggggtgggggggccggaaaatggatcccaggcccaggcggggctgtagccgggcctgagacgagcaacgacagcgtctccgaagaaaggttccatggagggccccgtggggtcccagcggtcctttgggagcagaagagtctgaggagcgcttaccttgatagttcctgttgaatttcccggaatttactgaccacgaaagacctaaaaatctgctcgatgttggtcgccatggcgtccgctccgttctctcaactcctcctcactagtcctccaggctcccagcatgcctcgggaggaggcgcagcggccaattccgtctctcgccgtcctgattggctcctgtgggagagcccagaccggcacgctccgcctccgaacctatcagtgagcacggccccgctctccttcgctgtttctgagcgtctagggtagagctgctgacgtttgcgccgcgcacgactgtgtccgccatgttagtgactgacgcaggcgccattacaggagaagtctctctcgaggtggctgtgtcagcttcagttgtcagtcttcaccagcgttcgtgggggagggggcgtttaagaggcttattttagtcactaactacccgagattaaattccgtgaggaaagggagcgggaagggcaacagggtgctccaacatgtctcccgcgtttcggcaggggagatccctccgggaaagcatattatcagcgcctgcccaccgtacgaagaataacgttttcatccccccatctctctcccatggcatcctataatcagctttttttcccccccccattttagcattgggtcagaggtcacgagccagctgagctcaaaccctggtgcattgtaatctcgtcaggagccaggcgcgtcacgagacttttgcacagtagccggtcagttctgattcctaagcaacacacaagcagctgaacatgggtttagcattttggcgctccccaccctcagagctcaggaggttctggagggggagaatagattttacgtggcacctggtaccacaaaattaaacactgtaaacgagtaaggcttaagagatttgctcgggaggggaggttcaggccgcgcccgagagcgagagggaatcgttcttgattaccacggggtggggaccaccggccgcgccagccaatggggaggcgaagccagtcgagggcgggatgggaggggtgtgcgcgccgggttccgcgcgcccaacttccggcgcgcgtggcgtgcgttccgatccagagcgctcggcgaaggtctacgcgccatccccaaggtcccccctggatcgccgggtgagtttcctatgcctctcagtaaagttgctttacggtttggtttggcggatttactctcaggcatgagatgaaactatctgaaccggtttggctgtaggaattgtcatctcgtttccacataccatgggtgaaggttgggcatgtgctttttcagttttaactgaggtttacaacgggtctgtcattttctctgctttaggtgtcagggccctttttgtacctttatgcttttttttatgtcatgcaccagaattgcatattttcttgttaattccgttctttgtctctagcaagttacttaatcccattttgcagttggtttctatgttgtgttattcaccaagtcttttgaaatggcttttctctgttatgttatccattcagacgactgaggcccaagaaggttaagtccctccaggtttcccagctagtaagtcttaacccaatcccaggtcttctgactgaagggctcctagcctctcctggatgtacattccctcagtcttgagtcctaaaactatttcagagatctatggcgataatcctctcactgcccctgtaattcacactaatgtcttctctagatttaaaggtatatttatttcaaatatttcaatacacatggcaactctatgttttccattaaccattttcctttctgagataacttagtaaatttttttcttcttcatattttcaattgtatctgaagcaaaattgcttctgttggaatctcaccctctgatctgtgtgacctgcagcaagttacttaacctaactgaacctcagatatgtttatcagaaaagtggatagtaatcctatctgcctcatagaattttaaaattaaaagcttttagagtagcatctggcaagaagtgctcaagaagtgtttttatattatcaatttagatttttctttaaatatgtattcctagtatttcataagtaactgatttcagtttttcctgttaccagtttgcattctaattagatgtcttctgaaaattagtaaatgaatatgacaaatatgacagattattcactcttttggctttctagaatttctatccctgaagcatcagtttagacaaaagtaatcaaatgtagcatgttagcattcttttactactgagtgtatgcacttgtaataattacttaaaaataaatggcatttcaattcttactatgcctcataaggcacattcttaattccaccttgtaagatgcatagaaattgaattgcagacagtaagagcttaaccaaggtcacatgctaacttgagcggagagatagttacccatcctgctcagcatcagatgccagaactaagtgagaggtgtttaaatttgatttttgccttctccaccaatttcctttgggaggagggggctgctgcatcccatgggcttagctgccctttggcacgtgggatcttccgttccccaaccaggaatggaacgcacatcccctgcattggaaggcagatttttaaccactggaccaccagggaagtccctttgccagcatattgcacttaaaaaaaagatttatttacttatttgtatttttggctgcactggatcttttttgcttttgctttctctagttgcagagagcagggtctactctttgttgtagtgcatgggcctttcatcatggtggcttcccttgttttggagcaggggctctagggtgagggggcccagaagtgctcccaggctctaggatgctagctcagtagttgtgacacacatacaaccaatgctccaaggcatgtgggatcttcccatactagggatccaacctgtgtctcctgcattggcaggtagagtcttcaccgctacaccaccagggaagccctgcaccagcttcttaaatggggatcagcagactatagctcttggtaccaatccttcctactacctgtttttgtacagctcactaaataagaataatttttatgttgttaaatggtggcgggggggggggggatatgatatttctatgacagttatgcaaaattcaaattgctatatccataaataaagttttattgaaacctagccacacttaattctttataaacctcttacagcttcttgttgcttagagcagaaataggcaaactatgactacagcccatgcctgttttgtataagtttttgctgagcatagccaggccacatttgtctcttgtccaaggctgctctttgtgctacaatggcaaagttcagtaattgcaacagagactatatggccatcagaatttatttatttatttggctgcattgggtcttctttgtggtgcacaggcttctctctagctgtggcactcagctgcagcacagtagtatattgtgcacgccagctacacggcatgtggtgtcttagttccctggccagggatcaaacccatgtcgcctgcattggaagatggattcttaaccactggaacaacattaagactcatttttaactgaggtttgatggttattaaatcttctaaaagtgaagctctagaaagggtgattgttggtagtttttgtttttttttaaatcaagctctctaggccagtctgccttatttctaaagtaccacgctaatccttaagagtacagtcatatttcttaaattatgaatcccagtttaaaacggtcaactgtggttttctttctgcagctttcatcttcctgctgaattcctgctttgcagatagcgcaatggcagcccgagtacttgtcattggcaatggaggacgagaacacacgctggcctggaaacttgcacagtctactcatgtcaaacaagtgttggttaccccaggaaatgcaggcactgcctgctctgagaagatttcaaatactggtaatgactttttttaagtaaaagtgaacaattgtaaatgataaactgtcaaccacatctgttctttgtaatagtcaattgctgttcagatttgaatgctttgcttaacccaaaaatgtatgtggtaatttgaatagttgccatatgttataaatttaaggtatcctgttgttcaggttatagcacttccttaccttaaattagtttaaacctttaaaacatgtctaataagaaagtcacaaagcagtacctaatacagattcaaggtgtttggctatgtattttggggaatgaaaaattgtgcagagtaatttgagacttcaagcagattaggaatggtggcccagatacagtgaagtggaagagtgcctataaaaccagctcatgctcagtatgtggttgatcccagtactacttagaacttcgtcgagaaagaagatttacctcattggtaggttgggaaagtgaggaaggtcataaaatcaccgttctattcttagcttaaacatctttgcacaaagagcccctgcctggctgagttagaaatagcctcccaatttacttcacatcagatttgcctaactttattagtttgcttggatagtcataacccagtattcccatagtgaaataaaagcatcctaagtgtagggaccctatttgtgtgtatgtcttaactcagtgactaggacagttatctagcacatagtaatttttagtaaatcttgaatgaaagacatttaaaaggccagtttctgagtatattctctgatacactgttttgtttataatcaacactagtgatatgaacgctacagtcaggagagtacagctcttgggaaacttcctcagttctctgtcactgtagtgataacagagaattcagctttgttggttagcctaatgtactctgctctgaatttctcatggtgaaactctcctgcaacactaaaggaaaatcatcaattgattggcataccagagtatagtacttaaacttcagcaagacacttacttattataccttaaacaaagtatgtttatataaacaagatgggtttgtttcttttctcttttcacagacatctcaatcagtgatcatactgcccttgcgcagttctgcaaagatgagaaaattgaattcgtagttgttggaccagaggcacctctagctgctggtaaagttcatttctatttattgttacgatttatactgtgccaacaggagcttggagatcatctaatctcatacattttacagatgaggtttcctaatacaacattaccttgggaaaagttttcactctcttgaaatttatggattctaggatttttttcctccgaagaattactactctggataatataaataataatatgattaaatttgaatgagagatcaaatttgcagccatgagaaatattttctttttattctgctctatccatatatttgaatatcacataaatttttgttgtacttgactcatgtgtaaatagcattttgttatatcctgtagaaagcaagaaaaatgttcatgtttcctattctctgccatctgccttatctcagtgtagatttagtctaatcctaatgcttcagaatgaaaaggccctgcacagacctgactaaggctgcttattttcatcactaggaattgttgggaacctgaactctgtgggagttcggtgctttggccccacagcacaagcagctcagttagagtccagcaagagatttgccaaagagtttatggaccgacatggaatctcaactgcaagatggagagctttcactaaacctaaagaagcctgtgacttcattatgaggtagatagaagacagcctgtgaagggcagttatcttgttatcttattatgatattggaatgtatgagtcactgttacaagtttatagtaaggtaattctaggggaaaactcatagaatatagattgcctttttccaacatcaaaataaaatgagattcactcttgtggccttgcagaaggataagctttttaacaattctgctgaatagtttatagggggaaaggatacatttggttctgtagtcatgcactgttagccaaattgacatagtggcatcttacaacgttggagaaggcaatggcaccccactccagtactcttgcctggaaaatcccatggacggaggagcctggtaggctgcaatccgtggagtcgctaggagttggacacgactgagcgacttcactttcacttttcactttcctgcattggagaaggaaatggcaacccacaccagtgttcttgcctggagaatcccagggacgggggagcctggtgggctgccatctattgggtcacacagagttggacacaactgaagcgacttagcagcagcatcttacaacataaagggtatggattttttttcatagctagagagaagaatcatcacttggccttctgccaccactgttcaatcctaaatcttgaaattaaacatcctgttctttattctatggaaaataatgagcaataagtgaatgttcgaagatacatgcctttgccttttttttgttgacacatctagctacttggtatgtttttgtgttcagttcagttgctcagtcatgtccaactctttgcaaccccgtgaactgcagcacggcaggcctccctgtccatcaccaactcctagagtttactcatactcatgttcgttgagttggtgatgccatccaaccatctcatcccctgtcaaccccttctcctcccgccttcattttcccagcatcagagtcttttcaaatgagtcagttctttgcatcaggtgccccaagtattggagtttcagcttcaacatcagttcttccagtgaacattcaggactgatttcctttaggattgactagttggatttccttgcagtccaagggactctcaagagtcttctccaacactacagctcaaaagcatcaattctttggcgctcagctttctttgcagtccaactctcatatccatgaccactggaaaaaccatagccttgactagatagacctttgttggcaaagtaacatctctgctttttaatatgctgtctaggttgatcataacttttcttccaaggagccagcgtcttttaatttcatggctgtggtcactatctgcagtgattttggagcccaagaaaataaagtctgtccctgtttctggtgtttcccatctatttgccatgaagtgatgggaccaaatgccatgatctttttctgaatgctgagttttaagccaactttttcactctcctctttcacttttcattaagaggctttttagttcttctttgctttctgccataaggatggtatcatctccttgtctgaggttattgatatttcttccagcaatcttgattccagcttgtgcttcatccagcccagtgtttctcatgatttactctgcatataagttaaataagcagggcaacaatatacagccttgttgtactcttttcccgatttggaaccagtctgttgttccatatccactttataattgttgcttcctgacctgcacagaagtttctcaagaggcaggtcgggtggtctggtattcccatctctttcagaattttccacagtttgttgtgatctgcacactcaaaggctttggcatagtcaataaagcaaacgtttttctggaactctctggctttttcagtgatccagcaaatgttggcaatttgatctctggttcctctgccttttctaaatccagcttgaacatctagaagttcacagttcacctactgttgaagcctggcttggagaattttgagcattactttgctagcgtgtgagatgagtgcaattgtgtggtagtttgcacattctttggcattgcctttctttgggatttggatggaaactgatcttttcgagttctttggccactgcagagttttccaaatttgctggcatattgagtccagaactttgacagcatcatctttcaagatttggaatagcttaactggaattccatcacctctactagttttattcataatgatgcttcctaagacccacttgactttgcattccaggatgtctggctctaggtgagtgatgacaccatcgtgattatctgggtcgtgaagatcttttttgtgtagttcttttgcgtattcttgccacctcttcttaatatcttctgcttctgttaggtccataccatttctgtcctttattgtgcccacctttacatgaaatgttcccttagtatctctaattttcttgaagagatctctagtctttcccattctattgttttcctctatttctttgcattgatcagtgaggaaggcttatgtctccttgctgttctttggaactctgcattcaagtgggtatatctttccttttctcttttgcctttcgcttctcttttcaggcctcctcagacaaccattttgcctttttgcatttctttttcttggggatggtcttgatccctgcctcctgtacaatgtcacgaacctcctatccatagttttcgttttagttattcttatttattctttattctacgttgaagtttatcgttttctagtagccagattccttggacgtaacaatgtagttactttctgtaagtctcctgggtctccaggtctactcaacagaaaaaactaccaacaacagtttctgacgtgtacttggagcagttatgtatccgtgcttatactggtccatgattcactactttgtatcttaaagatctttccttacccatgctatactgctgctatttcttctcccaaagatttgttggtatgctctcagggtaggtgagaaaagcaaaatcgtatgtaacgtctgatcacaggcaactactgaggaatacagaagaaaagaatcctgataagaggtgcatcaaaatggtgttagctgtttttttagttgtttttagtttttttctgctttttagttgttgctatagcatatcatcacaaaatctgaaagtattttaaacttttgaatcgtaaggatttactgaatactgaaacttcctctgtcttcacagtgcagacttccctgctttggttgtgaaggccagtggtcttgcagctgggaaaggggtaattgttgccaagagcaaagaggaggcctgtgaagctgtcagagagattatgcaggtaagttgatccttttgaaaaactttcataattttctagtcacactggataactactcccaatttttcaaatacttacaaattcttatcctcaagatgaggaaaatgggtagtagttactgtttataatactatgtattataatccatctctgtaaaaacaagtatctgttcttggagtctcaagtctaagaaaagtgaaacaatgttaatatatattgctttttattttaatatattttgcttttttttaatgaaaaaaaagtatttttggctgtgctgggtctcactgccatgcacaggctttgaccgcaggctgacaggtggccactcctcactgtggtgccccggcctctcactgtggtggcctctcctgctgcggagtgcagactccaggcacatgggcttcagcagttgcagcacacaggctcagtagttatgcacgggggacttagctactctgcatcatgcagaactctccgagaccaggtattgaactcgggacccccatactggcaagtggattcccaatcactggaccaccagggaagcccctaatgttttgcttttatgatccatcttggttgttttgggtttctccatcttttggaaatctgctttcacagacactacggtaaaattactataaccaaatataattgtaatcggaaataagagtgaagaagtgatgatgaaaacatctgtttttctgttgccttactgaacctggaaaggaggctacccaggagggttctaatgatgtattcatttcttctgtaccagtgctaactctacatcactgccactttaaaaataggagacattcatatgttcctatgcggctttcagaaagggaaagagaaattataaactagtgcattggttcattatacaaatggtgcaaaatgaagcagctgattaaataagtaatgaaagcttatagtttctctttgtattttatctccaataagggtaaagctttcggagaagcaggagaaacagttgtcattgaagaacttcttgaaggagaagaggtgtctgtatgtatatccatcttttgaacttgtatagagtatacgctgtgttatctgatctatgatccccaaaaaaggcttgatttgttctggttgcttcaaccaagagcataaactgagcaatacaaaggaatttgtatgtgtttagtattttggatacaaatgaaaaagtaatttatcttcttttaatcacccctagtgtatcagtaggggaactggacttatatcacacattatctaaagagggggaaggttgaactattttactttagggagtagcttgacctgccccttgaccaacctagctcaaaaattatagatccttccgaattgaatatacaaaatcttttgatacttgatctaggaaagttatttatgttttaaatcattttacttaaaaaaaaaaaatctaactggagttaaggtatgtatagttctgcttatgaaatttttttttttttaactttttggcatggaaggttaagtggactgtttgttttttctgcagtgtctgtgcttcactgatggacggactgtggcccccatgcccccagcacaggaccataagcgattgctggagggcgatgagggccccaacacgggaggaatgggagcctattgtccagcccctcaggtagccatcatttggtctttgcaaagaactctttgacatttttactttttcaagtttgtttttgtttttttcctgtaaatgacattacgaatcagcaaattgattttcctgataaatgaaaaatatcttttatggcctcactttgggactaaacttttctaaaagcctttgtgaaactaactttgtggattaaacagatccttccagcccctcctttctacaccctgtttttaccccttgagccagttataatctggaattaattatgcatcttttggatatccagggcccaacaataagtacttagtaagagtgggtgtgttacatcaagaagcaagtcagactatcatttcttcttctctttctactataatggataaagtatgtttccacacaattcctggacagttttatgaaaaatctgcattgctgctgctgctaagttggttcagtcgtgtcctactctgtgcgaccctatagacggcagcccaccaggctcccccgtccctgggattctccaggcaagaacactggagtgggttgccatttccttctccaatacatgaaagtgaaaagtgaaagtgaagtcgctcagtcgtgtctgactcttagcgaccccatggattgcagcctaccaggctcctccgtccatgtgattttctaggcaagagtacgggagtggggtgccattgccttctccgaaatctgcattgagtatattataaatagcacttaaaaaaatagcacttagaaactctcatttcctttcactgatgatagttaaaattgtgctgataacatggtgccctttcgatatttttcttaactaaaagattaaaaaacaaacatggtttactttagactctatgtattaaaactaccatttggtgaaaatgattttaatataagaactaactctagctctaatttttgtaattttataaactctagattttcaacttacaggcttatgaggtatgcagactatattggaagtatacaaaggagcctcaatgtgggtgaggacttttttagtttaataccaattacatttaaatatttctctgtattccccaggtttctaaggatttgttgctaaaaattaaaaataatattcttcagaggacagtggatggcatgcaggaggagggtatgccatacacaggtaagcacatggatgtcattgtggacatgattcatggaggaagtttacagcattttctctttttttaaacgacttttttattgaccattgttgtaacattggttatggtcattccaaaaccttgagtctatattctaaatttcatagtcaaaatacccgccgccgccgctgccactaagtcgcttcagtcgtgtccaactttgtgtgaccccatagatggcagcccaccaggctccgccatccctgggattctccaggcaagaacactggagtgggttgccatttccttcccccatgcatgaaagtgaaaagtgaaagtgaagttgcccagtcgtgtctgactcttagcgaccccatggactgcagcctaccaggctcctccatccatgggattttccaggcaagagtactggagtggggtgccattgccttctccgagtcacagtacaatgtctgcattaacgattttttttttcttttttaatgaaggtgtcctctatgctggtataatgctgaccaagaacggccccaaagttctggaatttaattgccgtttcggtgatccagagtgccaagtgagtaaaaaaagatgcgtgctattttaatcttaggatttttcagccttgaaataattattacctttgagaaatataatgcaaattctgatatttcagtgaataaaatgtcccaggagaattgaaatttctctcagttgtcatactgattgtgtgttttccaggtgatcctcccacttcttaaaagtgatctttatgaagtgattcagtctatcttagatggcttgctctgcacttctctgcctgtttggctggacaactgtgctgccgtaactgtggtcatggcaagtaaaggttatccaggagactacaccaagggtgtagagataacaggtgaacatcagggaatgcaaggttgggagacaatgtgaacagtaccgcagtaggcctttgtcccatggaaagctccctgtaagggtgtgaggccatcagtatcttttcaggggttcttaacataactctgttgcttattgcttggatatgggtgtccagatacctaaaattgctatatttaggaactgctatccatttccctttctgcacaatgaagacttacatgggcctagccaagtttacggagaatcacccagtcctgcctttcttgtccatcctctgagagccagtaagataataggaatatatgagtcagaggaacataagtttaaactacataggttcaggtcagttcattcgctcagtgttgtccaactctttgcaaccccttgaaccgcagcacgcctggcctccctgtccaccaccaacttgcagagtttacccaaactcatgtccattgagtcagtgatgccatccaaccatctcatcctctgtcatccccttctgccttcaatcttagggtcttttcaaatgagtcagctctttgcatgaggtggccaaagtattggagtttcagcttcaacatcagtccttccaatgaatattcaggactgatttcctttaggatggactgattggatttccttgcagtccaggggactctcaagagtcttttccagcactacagttcaaaaacatcaattgttcggtgctcagctttctttatagtccaactctcacatccatatgtgactactggaaaaaccatagccttgactagacggacctttgttgacaaagtaatgtctctgctttttaatatgctgtatcaaggatgttgtaaatttgaaatataaatttcagatttcaggatatgatctctgatcacagattaacccctcccccagtttgcagtatacccatagtcactttgatggcagaattaaagtagtttcagaactatagccttctcttttgtttctctttataggaggtgaggcatctatcagtagttaaatgattgtaaccaatttatatataactcagtgttttgttttgtttgtttgtttgtttgtttgttttttaactcagtgttttaaaatggtaaataagttccagacaccctatttactgtcttacccagacaggaagtccattgccctataaataccacacatggtaactgggcagttaggaactgattgccttttaaaacaaagaaagggaaggaatagaatcaaggtcattgtattggtaaaatttccctaaagttttagtgacaagtaatagtttctgatgccccaatattagatgctactgataccaccaggtcaggcagcaacagttagaactggacgttgaacaacagactggttccaaataggaaaaggagtatatcaaggctgtatattgtcaccctgcttatttaacttctatgcagagtacatcatgagaaacgctgggctggaagaagcacaagctggaatcaagattgctgggagaaattatcaataacctcacatatgcagacaccaccacccttatggcagaaagtgaagaggaactaaagagcctctagatgaaattgaaagaggagactgacaaagttggcttaaagctccacattcagaaaactaagatcatggcatctggtcccatcacttcatggcaaatagatggagaaatagtggaaacagtgtcagacttcatttttttgggctccaaaatcactgcagatggtgattgcagccatgaaattaaaagacgcttactccttggaagggaaggttgtgaccaacctagatagcatatttaaaagcagagacattactttccaacaaaggtccgtctagtcaaggcttatagatgtgacagtgagatggtgaagaaagctgagcccctaagaattgatgcttttgaactgtggtgttggagaagactcttgagagtcccttggactgcaagatccaactagtccatcctaaaggagatcagtcctgggtgttcattggaaggactgatgctaaagctgaaactctagtactttggagttgtgcaaagagttgactcattggaaaagaccctaatgttgggaaggattgggggcaggaggagaaggggacaacagaggatgagatggatggatgacatcaccaactcggtggacatgggtttgggtaaactccaggagtcggtgatggacagggaggcttggcatgctgtgattcatggggtcgcaaagagcgggacacgactgagcgactgaacttaactgataccaccaaatatttgggtatctatgactaaatgcccctatcttatagaaacaccaagagaagatattataaaccactgtacttcaatttttttaaaaaactttttttttaattgatacagaaaaaatttaacattaccaaatacagtgctaaagagaaaaggaaaaggacaaactgaggatataaaaattttttttaattaagaggttatctttgtatgaattgcccactgcataatttagaaaatatagtttagtaatatttaaaaaggaaaagcaaccttatctagttggctgtggtaaagcaaaaaaattctttacctctaaagtaaaaagtgatcaggatttattcattgatgtttaagttttttacttttcaggagaaaataactgacttctagtaccaaacttttcagagcttgcctttttttttccctttattgaaataatcatttttacatgagatctatgataaaaagctttagtgtaatacagttgtcaccctagagcagaacaggctgttgttagaaggaaggttcgatttactgttatatcacataattcctttctgttaggattcttgtgaagattcatttaaatgaaataaagattttacttttaaaaaaccctctcgaataagccacagtgtataatattattactgtaattggtgtatcaaatatgctttctcttacagggtttcctgaggctcaggctttaggactggaggtgttccaagcaggcactgccctaaaagatggcaaggtggtgactaacgggggtagggtccttactgtcacggccatcagggaaaatctcatctcagctcttgaagaagccaggaaaggacttgccgccataaagtttgagggagctgtttataggaaagacatcggctttcgagccatagctttcctccagcagcccaggtaaacttgtgacccaggtgatcatagcacagctttaaaactggcagagatggtgatgtagaaaactccactgaacctgaacaaaggcattctgtattttgaactctgaaactggtccagttttgatttgcatttagtttgaatcaaaagtattagttatattcaaatgaaatggaaaaaacttcgtggtagctcatatttgaaatgtgctgttaaaaggtttttttcacattctacattttaggtgtatgcaataagctgtcaattattcaagaaaaataggggaagggatttttattccttgatttatcatatatttacgtattactgttatatatcttagttatcctgattttgtcaaaagaatttgagatgtaaatattggttatctttacagctttgattatactataaattttaccacttcatttggtcattgcatttatattactgaagtgtatttataacttcacttattgtcatatatagctattcctttgtaaaatatgaataaactattaactgctgatgtgggtgtcttgatcttatcatagtatgttcattgagttcatgtatgagaaatacttgttttaggacaaaatgcgagtaacatgctaaaattttgtttttttaacttttaaaatgagtagattctgggctttccttggtggtccagcagttgagaagtcaccttccagtgcaggagggtgtacagggttgatccctgatcaggaagccaagaccccacatgccttgtggccaaaaaacaaaaacaaaaaacagaagcagtattgtaacaaattcaataatgactttaaaaataatccacattaaaaaaaaagaaattagatcctattgaaatttctaatcagtagaacttcatttcctatcctagtgtgaccctggactgccaacttttttgtagttagccgccaaaagtctcaaatctgtttgttccctggcatcttgtttctaataaaactagaggtatttctttcgatatccctgaatcccactaggccagtgttgtttttgtaaggctagatcaccaaagtcacagtgccatttaacatgactgggcttccccaatggctcagtgggtagaaaatctgcctacagtgcaggagacatagaagacactttcaatccctgggtcaggaagatcctctggagaaggaagtggcaacccactctagtgtttttgcctggagaattccatggacagaggagcctagtgggctacagtccatggtgttgcaaagagtcagacaggactgagcaaatgagcactaaatggaatgctctagcttgttggcactattacaaagatggaaatgatgcattgaatatcattacctggtttcggtggggttttggtgtgggggtttttttgttgttgttgttgtttttgagtttttaaaatcatttcttacagtctttataagaaaactgatacagttctctattactgcagtaagagctcagtttcattattaagggatttctttctagagttcttaccatcataattttcacttttttgactcagttttggtactctttccttcccataccaaaattgaatagagaaaggttgtggccaaatgttgatttatttacctgcttctgacagatacttctggaagaaatagacaagttagagaagtagttccaaatagtgattatcaagtggggaggttgttcaaacatatttcaattcctaggacctgccctagaccagccaaattaaaatctctggatggggccaagtacattaggggatctgaaaaatgcctaatgaatatcttctgctttaaataataatttaaggttaaaattttccctggtgatgtcttagtttattttttgaactttttaggggcctgacttacaaggaatctggggtagacattgcagctggtaatatgctggtccagaaaattaaacctttagcgaaggccacctccagaccaggtaagtcagatcctgtcctttgctagttcatcaaccatgacaaacattgtatattgatttggggcttcgtagataactgaagaaaatgttccagactaatgccaagttgctgtaagtcttgtcctctttaagccaaactcatagtcttctgctttcttacctctaatagtagggaaagcatttcatatccctaatcttaaactcaaaaggatgtgtctgccccttcaatatctgctttcttgatcagtcctttgctgttgaaatgcagcaagaaacaaattttctctccaacaggctgtgatgttgatcttggaggttttgctggtctttttgatttgaaagcagctggtttcactgatcctcttctggcttgtggaacagatggtgttgggacgaaactgaaggtaatcagacacttatgtgagtaaaggccttttgtgaaagatatgaatttactgtgtatcaaatatctttctcctcttgacatatatgcactaaagagaaccataccaaatattgttttgctacaatggctacatgtttctaataacgcagtgtctttgagagtatatctgggacaaaagagaataattctggaccaagtagcttatcaaaatttagtgttcttttgtctttaggtgttcacagcactagccaaaagtcattatttgttagccttctctgataattgacaagatacagtttggaacttactgtctaatgcggatgtttatacccttcggtagattgcccagcagtgcagtaaacatgacaccattggtcaggatttggttgcgatgtgtgtaaatgacattctggcacaaggagcagagcccctctttttcctcgattacttttcctgtggaaaacttgacctccgtactactgaagctgttatcactgggatcgccaaagcttgtaaaaaggctggatgtgctctcctcggtatgcacttccattttaatcacgcaccctcaccgcgtttcagccctgcgtataagcctgattggtgactagtatagccagcaagacaaactgtgtgccacacgatgaggcaaacaaaatacagacagcaccagctaaggaaaatttaaacctcggtgcccccaaaccctcccctcgagggtcagactcacacttcaacaccatcagccagggcttgtcttcccccctgacccttggcccctgtttgactcccatgtctctcagtggcctcccggacagacagggcagggacttgtttcctccttacggccctgcagcagaggcaagtcagttcctggcattctgactctttaatttaagccttcatttcccacagaaatgacactaaggataaaatgtacccaaggtttatagaactattgcaggagtacatacgtgagggttttaacaagataaatttgtaggttgaccagagaacaaaactaccttttttacatccccatttctgtggacaggcctatcccaaaagccaaaattgcctttcaaccatcttttagaaccattcctgatttaaatctgcctgcctagaccctgtctttatgggatatggtggtaatgtgaacttgatgtatttattaggccagggcatttagagttaggcagacctgattaaatcactcttctaagcctgtaccattattggaacatgaggtgattgtaaagatcaaatgtaggtgaaagcatttctgaaactaaactgctagagaaatggcgttacgtccgactgagcattcattctgtaaaaataacgatgtttggaggctatattcaccctttgtggaaattagtgctatttcccctgaaatcatgcttggttgagagttctgttagatggcccttagagaacattttactgaatgtttgcagaatacagcttccatttaattgtccttttgaagagtagctggtgtcagtcactacttcctagacaggtgtataaacattcagtgatttctttgttcttgttttctcttcctgccaggaggtgaaacggcagagatgcctgacatgtaccctcctggagagtatgatctagctggttttgccgttggcgccatggagcgggatcagaaacttcctcaactggaaagaatcacggaaggagacgctgttattggaatcgcttcatctggtcttcacagcaacggattcagccttgtgaggaaaattgtagcaaaatcttctctcgagtactcttctccagcacctggtggctgtggtgaccagaccttaggtacacacgctcacgtttaaactctcctacttggaaatgtctgagcagccagtcactagggttaggctgatttcattacttaaagtactcttaatactaagagtattaagtactaaagtactcttaatactaagtactcttaatacttaggctgtggtttggctgcttagacattatagaacaggtgtatctggcagggtcacagtcctcctctgtttcagaattattttttatgtatgctttggtttcatttcatagacttaagtttttatcttatcttcccaatatacaggtgacttacttctaaccccaaccaaaatctacagccgctcactgttacctgtcctgcgttcaggacgtgttaaggccgttgcacatattactggtggaggattactggaaaacatccccagagtcctccctcagaaattgggggtgaatttaggtaagatcactaaaaggaaattttgctcagaaaactattagaagaaaaaatacattatggaaggaaactctttgggtagtttaaatacatataggattatacccagaaattattcatcatttggacttcttgtggaaaaaataggactgaccctttaccatatcttttcacttcattggccatgtttataaggcatagaccaagtgaagttgctcagtcatgtctgactctgcgactgcatggactgtaacctaccacgctcctccgtccatgggattttccaggcaagggtgggttgccatttccttctccaggggatcttccccacccagggatcaaacccaggtttcctgcattttaggcagatgctttaccgtctgagccataagggaagtcctacatataaggcatactactactaagtcacttcagtcatgtccgactctgtgtgaccccatagacggcagcccaccaggctcccccctccctgggactctccaggcaagaacactggagtgggttgccatttccttctccaatgcatgaaagtgaaaagtgaaagggaagtcactcagtcgtgtctgactcttcacgaccccatggactgcagcctaccaggctccttcgcccatgggattttccaggcaagagtactggagtggggtgccattgccttctcccacatataagacatacagccctgtaattgacttatatcagatgaaattttctaagcagattctccagagggttggtaagcttaagctctgtcaagatagaatcaggaacttgctgggagggaaagggaagtggtagttattaaatagtccatgtgcgggataaagaggacccaaaccaaggcattgtgaagagagacagaagaatcattgtgtacttagcatgaaaaaagaagtcccaggtttctggtttagtgggtgcataggtgggaacatgcatagaaaggagaagagtagatttgaatagagaatgagaatgcagtgttttaagtctttgacatgttcattgcagtatttctgtgggaagttaaaacagtctgaatcagggagtaaaccatgtgaacgtatcaattccaagcaaggttttcaacatgacactggttagcaatgtcaaaaagcaacttgagagggtagattccaccccccagattattggcacaagggatgatagcagagatacagagacaataagtgaagattgctgtttcaagaaacttattggttgggaattccctggtgatccagtggttatgagtcagcacttcactgtggtggcctcatttcagtccctggtccaggaactcagatcctgcaagccatgcagtggggccaaaaaaaaaaaaaagtttttaaacagacctaagtctagcttgtttgttgtttttgttatattttttggccccactgcacaatttgcatgatcttagttcctttaacaggaattgaacctggcacgtcctaatcactggactgacagggggttccctaaattttaaaataaatgcagaggggcagagtattgctcttaaactttctatatagcataagttttctacagtagtagctgtatttcctctaagtctgtatataagccactagttttgcatcaaacttagggtgtgttttggtcatcgctaagatccaactagacattctcagaggatagtatgccagcctttactggaattcagccccattagagcatctctttcatcagggaatttctaaggatctagttagttaatgcagcacaaaactaattgagcaaaaatttgctcaattgtgaatattggccaagtgtgacacaaaagtgttcttaatgccttagtacagatggatccccagaaagcttctgaaaggccagttagtagtttctccttatataaaatagctgtcctggttttaatttccataattttgtaaatgtgcatgcttttatactttgggtcaacagtagattaaggaacaattcttgcctgtttttagatgcccagacctggagggtccccaggatcttctcatggttacagcaggaaggccacctctctgaagaggagatggccagaacatttaactgtgggattggggctgccctcgtggtatcagaggacctggtgaagcagactctgcaggatattgagcagcaccaggaagaagcctgcgtgatcggcagagtggttgcatgtcccaagggtaacctcttccttcagtggctcttagatctataaccttcaatataactgtgccctgccttaggagctctgcctacccattgctatggcaactatctttacacagctgtcacgtggaaacatcccagccagtaataccacgcgtctcttcatttctgcctcagggtctaacccctgtgtgtagcagtcacacgcacaaccacaccctgcaggaagcaacccttgatcagtggggtgagagataatgagtcagcacccacttgagaaacagaaggagggagcggttctaggcacagtctgtctacatgcctcctttgagggtccctaggatcaagcccaagttgcccactgcggtgaccagctgaatagcacactcagtatgagtcttccccatcaccatcccctgtcacttcccagagcaatctctcacgtgaggacttgggtcaggctctgctttgtggcacaactcaattcgaggagcagtgagcaagcaccctgatgagcctgtattacccgaaactctgttagaagcactagaaattggcagaatggcagaaaacccattcagattctctaacagagatgtcaagacttgctaattttgcctttcattcctttactgtgtaggtttcattttcaggcaggctctccaaatacccataagatgtcttgagcccacatccttcaactcacattgcactaagagaggccctctctttctcaacatcctatatcaaacctttgaatggtcttgcttgttcacatgcctacccttgaagctgagaggtcatagcactagtgtggatggaagatttacaggagaagggagagaacactggcaggcactaacatatccactttatctacagtgctgtagcttttagttgaagttggcagtgtccgccttcagaaagtttctatgagtgagtaatgataagtaaaacaaacttactatttgttttaatcgtgcatattttgagaataaaataacagcgttctaaagtgtttttaaaacacttctctttccatattactgttaattcaaagttgttcttgatttacttattgagtacatttgcaccaaaggttctcctcgtgtgaaagtcgagcatctgattgaaaccatgcaaataaatggatcagtattggagaatggaaccctgagaaatcatttctctgttcaaccaaaaaaggcaagagtagctgtcttaatttctgggacaggtgagacatggctccctctttactacagagctgtagatatgctcttcgttttctcccgttcttccccctaaaaaaacctccaactgtgagaacactgttagtagaatagggctgaggattgttaaggaatgttagctattctgcatcctcagtccttccacttttctcaggcattttagacagcttctaaaggaaaattagagggtgttgggaagatggttgaagagagagaagcttttctagataaaatgcaaattgtaacttttcaattgtagctttatagttgaaaagtcttaagacagttgaggctttttttaattgtcaacagtaatttagtacaaaattttcatttgcctcttgtgggcagaggggtaaagtaataagagcattgttttctctcatatggatggatacagcacgattttttggcttatggggttgaacccaggcctttggcagtaagtggacagagtcctgaccgctggaccacccagcagttcccaccactgttttaagtgactttgctatgaacattcttgtaaatacagtaggttcataagtacatatcagattctttctttaaattacattatcagaaatataaatgctttacaagtctattttaaggtttcagtatactttagacccgagttgatggtaaagcaaaatgattgtaagaggtcagtcatagtggtttattcttcttgaaagtgttcgggtttttttcttgtttaattaagcagcttgttcctcatccttcagttttaacatgtgttgaactgtttctactgctatgctcaatcatattttgtgcttatgttttcatgagatactaatccattattccaagaggaaggaaatgtaaaagcttcacatattttgccaatctttaccaaggcatttttattcaaaaaccttgaccattccctatttgaagtatgtaaaccttttaaagaagtatgccttcacctgtgtttttttgccttttttcaggatcaaacctccaagctctcatagacagcactagggagccaagtagcttggcacacattgtcattgtgatctccaacaaagctgcagtggctgggttagataaagcagaaaaagccgggattcccacgagagtaagttactttgaaaagtatctttacagattattcaagctcataatctgcccctaaatgttcttaagacatctggatttggggtagctactaggcttgcctttccattctggttcattccttcattcttgatatcacatgtgtcttcagatggtcaatgtagtctatttataggttggattttaaattatttttggttaatttgttggagacagatggtacttacccatttctcttctaggtaattaatcataaattatataaaaatcgtgcagcatttgacactgcaattgacgaagtccttgaagagttctccacagacatagtctgtcttgcaggattcatgagaattttgtctggccccttcgtcagaaaatggaatggtaagtaaaaaactgtttgataccacattgagaaatcaactgaaaatgactctagggtggttaatttaccaaaccattccaggcatgagagatctactatgacattttattttgacatacataataattgaatttcctttgcctttagcccagagaatgacccagtgatgacttcttatccttcttcatcagttttctttggtgtgctataattatgttttctaagatagcttagattgctttcacattaatacaaatataatttcatcttctggataaatactgggaggagacttttttccttgtttagaagtgtgaaccactgccagaaaatggcaaagaaggtactattgtcagatttcacaggatccgctgttaatgtcaagagccctataagccagagtagaccccttcccatccagctttgagttactgccggcacctgttcagagtccctcattgtgtcttcatatgtgcaaggcagaaacctgctgctcccagggcctccttggatgaaaatgggtatttcacttttcctcatttctgtctttgacaatgaaaacacccaacctagagaaagcttgctcatgttgactcctgattctagacaggaaagtgtatattccagattctgaccacattttaattaatttccagggaaaatgctcaatatccacccatccttgctcccttcgtttaagggttcaaatgcccatgaacaagtcctggatgctggggtcacagtcaccgggtgcaccgtgcactttgtagctgtgagtatggctcgtgattagtatttgaatgtcagttgcacttgccagaggtaacgttcaaaacttctgctttcttttccaggaagatgtagatgccggtcaaattatcttacaggaagccgttccagtgaagaggggtgacactgttgaaactctatctgagagagtaaaattagcagaacataaaatatttccctcagccctccagctggtggccagtggagctgtacggcttggagaaaatggcagaatctgttgggtcacagaggactgaagcgtcatcccccgggaatggagacagctgagagcattgtaggtgctgcagggggacttttatcctggactccacctaaaagatgtgtgagacatctgtgtgttgcctccagtggtctttcaggttttacctgtctggggccttcttgttcataatcaaactaggccttcagaattccttttactttcagccaagtattataccaaaacttagtcttttctttttcaaagagctaacaagtctaaaaagttagtatcttgtcctcatattgtatatctgtactaatttgaattgagacttctcgatttattctgatcataagttgttatcataaaatttctgggtagttcccattgagggatagtgttctctgtgctttgaagaatcattacactttcctgtaataattgacgatttctataatacccagatttcagcttcacagtttgggaggatacaaggcaatctactcagaccagtaaagcgtttatttttttttttttatgttatttaattattgcaatagtaattttctgtttttcataacatgtacagattccacagtgttatggattaaacagtcttctgtctaaaaagcatttatattactgtttatttatattactgtatataaaaaagagttactagtaagtttaaacaattaacatactggttacactaaattttgaaatacaactgagaattgtcattgcttttaccgagtgaagcagacccttcctccttatgatcttttctcttctctccctcttctttttcaatttgttgtgtctttgtgtttgaaggcctccgatacataggagagaaagtctcttgctccacaaacataccttgaaattggattcttgctgaaaaatggaccttgtttcacaaatgatattggatccaatggcaggatgtgtttttttgtttcaaaattttgattgaaaatgaaagattctccataaaataatacattttcttggcacagctaaacacctggattctgaacagattgaatccatgccttaagttaaaaaaatttgttttgtgcttctctgtcataaatatgaaagaagttcagtaagtggattgcacataagcagtctctgtctggggaaaacccacacagatggtaattgaagtatttgttagtaagacatacaatagcaatccaaagatgaataaaagacttcctaaaattattcaaaacaaccacaatagagtattcaaaggatggtttttttttagacactttttgttatttccaaagaacttttatgacaacctcagaggtcctctgaccaagtcattcaatttctgaatatttttctaaggatatataaattgtcaagtacacaaagttacaatgcaccatacaatatggtttaatggaaaaaattgaaaagcagtttaaatctttatttatttatttagttttagggttttttctctttttattttttaactttataatattgtattggttttgccatatatcaaaatgaatctgccacaggtatacacgtgttccccatcctgaaccctcctccctcctccctccccataccatccctctgggtcgtgccagtgcaccagccccaagcatccagtatcgtgcatcgaacctggactggcaactcgttgcatatatgatattatacatgtttcaatgccattctcccaaatcatcccaccctctccctctcccacagagtccaaaagactgttctatacatcagtgtctgttttgctgtctcgtatacagggttattgttaccgtctttctaaattccatatatatgcgttagtatactgtactggtgtttttctttctggcttacttcactctgtataataggctccagtttcatccaccttattagaactgatttaaatgtattctttttaatggctgagtaatactccattgtgtacatgtaccacagctttcttatccattcatctgctgatggacatctaggttgcttccatgtcctggctattataaacagtgctggatgaacactagtaaagcgtttaaagggaccacatggtttccctccctggccagttgtttccagtctggatatgcaattctggaactgggaggtctaggttcacatactggacataatgcatatgaccctacaaacaggaccacatttctgtcacagctgagctaacagtgaatggccaccaggcccacaggcacttgccagccagccttaaacttctgagccactttcaaaggggcttaaaagttctgcctgcccagcagtgggcaccttactggaaggtacctcaaagccctgtacaagtcctcccttggagtttaaactcaaaacgttaatagtacaggacccttagagtagttacacatagaagatagtaagttcttgccttagaacaggaaagagtagagggtgaagagaaacaaagtcagatgaaaactgcctctggtccaagccaggttccccaggcagctgggcaacactaccctacctttcattgactgtggtcagcaactgccatcaaatgctgttccaggtacatcagttcatactggtacctttgctgcagaaacagtcgattcacttgtctagggagttcactcaacataattatgtgcctattatgtgcataattaagtgccaaacactatcctatgaagtttttagaaagttggaagatacaaagcaaaatgttatttagatgataaaatcacatcctataataaaagtagaagctgatatcaagatgtaaattagaaaaaccaatccgtttgtgacccaagaaatataattttccaacccttatttagacactaatccccataaaaagaaacctggactccatgtaaggcagctgatccaatatcttcagataggaagaatcaaaatgtgtcagaaatacctgattgacagaaccaaaaaaaaaaagcaggcaggactcttgcatactgagaggacaaaggagtcacatagggcgtcctgctgtctagtctgtgatagacagtatttggacatgctgagtgtatgtgcagccattggtttaaaatgatactcaagaaaaggtcatttaacttaaagaggcaatgcatagaagggtgaaaataagatgttaaattcttttgttaatgaaatacggatgtttgtctttaatgtctgtttctatttgtgtaagcaggattaaaacaaacaagcccctacaccgtgttcaggtataaagatatgagataggggaaagggggttcgactttaatcagttgtgcaggttacacacaacagtcaaagcattcaagtgtccatttcaaagggatgggtgagtcagatattctggagaggaatgttacaataatttttaagagattttagcctctaaatgtaccttcttaaatgtttcaccattttttaactactatacaaacttttaaaaataactcaagtacaaggaatcccctggcagtccagtggttaggactcatcacttttcactgccaaggtcctaggttcagtctctgttgggaactgagatccccaagttgtgctaaataaagttaataaagtaatgtcccaagttgagttaagcaactccagtacagtgtggcatttagttttagtaactggtgtagctagtccctcattactttgtttcaccagttttcttggctatttgctcccatgctgagcggtcagaaccacagccaaagtcgagccaggggaagacaagcaaggatgtgggtgccacggccaagtcaggctccctcagcctcgcttcagtgagcgctcagtctgtcgccgcttccacgactgacgtgcaccctgacttcctcagtctctgggtcacttgcccaggcaggatcatctgactggtcaagtctaggtcacaccctgctctaacggcctgaggtagagaaactaggacacggcctttgggttgcctcacatgatggtggatgccccacgtgacaaggattcccatgctcagagtccccgatttgacaaaggcccagctccaaaggtcaggtgacatgcagctgcaagaggtttgggaagactaataacattacagttattttttgaagttcacattatgctgacagttcctcttaccctttttatctgaactggtaaaaagcctgaactgctttttaccaattatctaatacgcaatttttacctcctccatccctatgctcttttagacagtcttctagccattctttctcaagccatgtaaaccttatattaaccacaaggctgtaaccagagataatctaaatgtccattacataacaaaatcaagtaaatgtagactatccctgcaatgaaatattactctgccataaaaaggaaataagtactggttgcaacatggatcaaccttgaaacattatactaagtgaaagaagccagtcacatgactgcacatttaagattccatttatgtggaatgtctggaacaagcaaatcattagagacagaggagattaacagtctcccagggctatgggaatagaggtttttggaggcgatgacctctgcagtgtctctcggggtaataagaacatagtaaaatcgattgtgtgaacatagttgcaccaccccatgaccacaccgaaaccactgaaccgtactcaaaaatggtgaattgtgtgccatatgaattacagtcgataaaactattcccccaaaagatacaactcctattaccataaaaagatgaatttgtataatttttaaaatagatcaggattacttttaatcttataaaatgcatcaaacatatataaaatactttcacatagagcaagaagtcaatacagacaatttcccacgctttgtgacagcatgccatctgctttataatgccaaaaattctgcctctctgcacctgtgccaaatcaaatctcagagtttgggtgaaatagaaaaggagaaccttaaaaaaaaaaataaaaggagaaccttacagctttgccaggtaaagatgggcacagaaggctcctggcttgaaaaagtaggtgtcctaacccggaaggatttgttgagttttataaaaacacttcaagggtggggttgctgacaagcttgggggtacgcgtggggtcacaggtggtgggtctcctgaccttgatgagttccctggtccctttaatcttgcctcagctggtttcttggctgctcctcactttgattagcaatgttcaaatccactctttggaactcagggaaggtcatggaggctggagtcttgcctacaaaaaatgggagacaaaaggtttccatgcccaggagcccacaggatccccctggtttcaaaaccatactaatccacctgaacagcaatcctagtccaaaaactgcctgttaacctggtaggtccctggctaagctgcttaaaagtgctaactcctgagccccacttccactgtgagcatggcaacacagcactgcatggatactactacaaatgtgctcagtcactcagtcatgtctgactctttgcgagcccatggactgtatcctgccaggctcctctgtccatggaatttctcaggcaagaataccggaatcggttgccatttcctactccagggcatcttcccaacccagggatcaaaccagcatcttttgcacctcctgcattggcaaggtggattctttaccactagcaccacctgggaagcctaatattacaaatagatttattttttaaaaggttcatgaattgaaatatctgttgacactgaagtcaaactgcattttaaatccttctgcaccacaaacctccaaaaattaatatgaagaaagttttctggagcaatatcattcaattccttgactgcttccattataaacaaaaccgaaacaagttctatcattaaacatttttaattaaatattcagctgagggacttccctggcaggccagtggttaagactcagtgctcccagtgtaagtggcacaggtttgatccctgacaggggaactaaaatccgtatggagaaaaagatcacctgacaaatatactagattatgttgaaagccaagtattggaaaccctccaattttgtaaagaatttatttcccattctccacctccacagcaaatcagccttttcaaacataccttcatttggtgtcctaagggtgttcacagcaccctgtaagacttaaggtatgtgtcaagtgtgccctttgtttaacatcactataatccaagtctatccccgaaccactgatggtgaagaagctcaagttgaatgcttctatgatgacctataagaccttctagaactaacaccaaaaaaaaagatgtctttttcattctaggggattggaacacaaaagtaggaattcaagagatacctggtgtaacaggcaagtttggccttggagtacagaatgaagcagggcaaagggtaacacttttcccaagagaatgcactgcaaacaccctcttccaatgacacaagagaagactacacatggacatcatcagtcagtcaataccgaaattagatggatgatattctttgcagctgaagagggagcagctctatacagtcagtaaaaacaaggccaggagttgactgtggctcagatcatcagctccttaatgcaaaattcaaacttgaagaaagtagtggccattcaggtatgacctacatcaaatcccttatcattatacagtggaggtgatgaacagattcaaggtattagatgtggtagagagactgcctgaagaactaaggacagaggtccataacactgtacagaaggcagtgaccaaaaccatcccaaagaaaaagaaatgcaagaaagaaacatggttctctgaggaggccttacaaacagctgagaaaagaggagaagcaaaaggcaaaggagaaatggaaagacatttccaactgaatacagggttccagataatagcgaagagagacaagcatcttttttaatgttttagtggttatttgtacatcttctttggtgaaatgggcttccatggtggctcagatggtaaagaatctccctgcaaggcaggagacttgggttcaagccctggatagggaaaatcccctggagaagggaatggctacccactccagtattcttacctggagaattccacagacagagcctggagggctacagtccatggggtcacaaagagttggacgtgactgagtgactaacactttcacttggttgaaatgtggtattcaaatctttgctcattttaaaactgagttaaatttctttttattaatgaattttaagagttctttatatattctggatatcagactcttatcagatacgtgatctgaaaattgtttctcacgttatgtggcatacatttccagtttcttaatggtgttttttgaagcacagatattcttaattttgatgaagcccagttttctattttttattacttgtgcttttggtatcatatctgagaaaccattgccaaatgcaaggttacaaagctttacatctgtttcgttctaagagttttatatttttgtgtgctaagttgcttcagtcatgtccgactctgcgaccctatggactgcagccctccaggctcctctgtccatgagattctccaggcaaggattttggagtgggttgccatgtcctcctccaggggatcttcctgacctggggatcaaactcgagtctcttacttctcctgcattggcgggcaggttcattaccactagcgccacctgggaagccctttgatctatcttgagttcattttttaatataatgtgaagcaagagttcaacttcattcatttgcaagtggatatacagttgtcccagcaccacatactaaaaagcctatttttcccatttgtcttggcacacttgttaaaaatcaactgaccaaaaatgtaatagtttatttctcgactttcaattacatttcattgatatcctacattcattgtctatcctatgccagtaccacaaagtcttgattacagtaggtttggagtgagttttgaaataaggaagtgtgactcctcacttttgttcttctttttcaagactgttttttctattctgtgttccatttaatatatatatatatatatatatggctgcatcaggtcttggttgtggcacgtgcaatccctgaccagggatcaaacccaggcctcctgcactgggagtgtggagtctaagctactggaccacctgggaagtcactattctgtgtacctggacttgccatgtaaatccaggatcaccttgtcaacttttttcaaaaagcctgactgagattttgaaaggaatttaccttgtagattaacttgaagagtactgccatctgaataatattgtcttccaatcaatgaatacaggatgtctttccttttacttaggtcttctttcatttcttccagcaatattttataatttttagtgtctcctacctccttggtaacatgtattccttattgggtttttttattttaatgctattctattaaatttttaaaaagctgattgattgcttttttgtcaccctgctaactatatacatcatgtgaaaggccaggctagatgaagctcaagctggaatcaagattgccagaattttcaataacctcagttatgtagatgacaccaccctaatggcagaaagtgaagaggaactaaagagcctcttgatgaaagtgaaagaggaggatgaaaaagctggcctaaaactaaacattcaaaaaactaagatcatggcatccggtcccatcacttcatggcaaatagatggggaaacagtggaatcagtgacagactttattttcttgggctccaaaatcactgcacatagtgactgcagccatgaaattaagacacttgctccttggaagaaaagctatgaccaacctagacagcatattaaaaagcagagacactactttgccaacaaaggtctgtctagtcaaggctactatttttccagtagtcatgttgtgagagttggactataaagaaagctgagtgccgaagaattgatgcttttcaactgtggcgttggagaagactctttgagagtcccttggactgcaaggagatccaaccactcaattctgaaagaaatcagtcctgaatattcattggaaggactggtgctgaagctgaaactccaattctttgtgaagaactgactgagtggaaaagaccctgatgctgggagagactgcatgcaggagaaggggataacagaggatgagatggttggatggcatcactgactccatggacatgaggtttgagcaagttccaggacttggtgatggacagggaggcctggtgtgctgcagtccatggggtcgcagagagttggacacaactgagcgactgagctgaactgaactgactgccctgggtctttgttgctataagcaggctttctcttcttgtggtgattgagggctcccctctcgcttctcattgctgtggcttcccttgttgcagagtatggattctagacgtgggcttgagcagtttcagaacacaggctcagtaattgtagcacacagacttaactggtccacagcatgtgggatcttcctggaccacggatagaacctgtctcctgcatgggcgggcagattctttaccattgacctaacagggaagccccacataggacttcaattgctgctgaacaaactcaatgcataggagaaaaagaagataatggatcttaactccagataaaaagtcttttttttttctggtcccctgcagtggaagtgcagagtcctaaccactgaaccaccagggaattcccttattaaaattctttacctataaatgaaatcctaagtttcccaaggattgatgaaggctgtctatcctgcagttgggatctcaaaaaaataaaaggaaaagataacactaactatgtgaggtgatgatatgttaatttgttaatcagtgtgattgtgatgattatttcacttgtacaaataccaaattaccaagttgcacactgtaaaagtatacaatttttgtcaattacagctcaataaaactggaaacaaattttgaagggtgagaaaaaacaagaatggggactttcacggtggtccaggggctaagactgtgttctcagtgcaggggtcccgggttcaatcctcagtcagggaaccagatcccacctgctgtaactaaaagatccctcatgcagcaactaagacccagcgcagccaaagacagagataattttttttctttaaaaaaagaaagcaaacatagagtagttgtgctgtaaagcagtgattttgataaacatgttgggtaaatgttatatgggctgaaaacaattcaaatcttgattctcaggctactgatgtgcagttgttttccccactattagcctgcaattggaggtatatacattattcattgtttcaaggaacagaaagcattcacttcagctcagtcgctcagtcgtgtccgactctttgtgaccccatggactgcagcacaccaggcctccctgtccatcaccaactcctggagcttgctcaaactcatgtccatcaagtcggtgatgctatccaaccatctcatcctctgttgtccctttctcctcccaccttcagtcattcccagcatcagggtcttttcaaatgagacagttcttcatatcaggtggccaaagtattggagtttcagcttcagcaccagtccttccaatgaacattccggattgatttcctctaggatggattggttggatctccttgcagtccaagggactctcaagagtctcctccaacaccacagttcaaaagaatcaattcttcagcactcagctttctttatagtccaactctcatatccatacatgactaccggaaaaaccatagctttgactagatggacctttgttggcaaagtaatagctctgctttttaatatactgtctaggttggtcataaattttcttccaaggagcaagcatcttcaaatgcaggctcaaatgacgataaatccttatgttgaatcaaggccaaaaagagaaaactggcatcctgggttggggagggtagtttttcattagcaaacttccacaaatcctgcgtgtggcccttactgaccaccttaggatgttagataactggttaacccactagggaagatgaagaacggaaaaatattcaaatgagtgtgaatctcttttccaggttacctcttcccaacccttgaagattttcaatcttattatgctaattaattaagttcatttacctctcctttcttttaaagctgacactgtctacaacaaacacttccttgatcagagtaaaaaaggaacagatataaccaaactaacaatactgttcctcaattctatttcaatagaataaaccaaaaacaatgaattgagatggcacccagaggaaagcaaattcatggtgtttctggaaattgtagtttcagaagatacaatttgcaaacatcattgagcaaaatgtgacttagaattcagatgggaccatccatctatcttcagggggctgtgattttggtttctatggtaccacaacttactggaaataaatcagcttctttgcagttatcacagaaccagcaaatgaaacgaaggaaggaaggaagaggggcttctctggtggtctagcagttaagaacccacgtgccaatgcaaggaacacaggctcgatccctggtccaggaagatccccatgccaaggggcaactaagccagtgcaccacaaatactgcgctcgcaagcccaaactactgaagcttgagtgctctgactctgctctgagatgcagcggaatgcacagatgagtctgtccaccacaacgatgagtggccctgctcccctgcaactagacaactaaataaagcccatgcacagcaaaaagacccagcatggcccaaaataaacaaacgaatctttcttttaaaaagaaacagatggaattaaaacacagccctcacatgctttagtcaaagcctgaaactatatccaagaacaaaaaaaaaaaaatgttacttttgcagtgccaagcttcttgcagtagctcagtaagtatttaatgtaactataaagtagaaaaaaaaattttaataacttttttaaagtatcacatctattttccacccactcagaaacacagttaatgactaagtttaacgctaatggaatttgtgccaactctctaccttccctggtttagggggaaatttgtttcaaaatgctcaactctattgtaagagtacagaattacgaaaaagatgtttcaaactaggacatgttacacacatgaaacccaacagactttaaaaccagcccttttgtacaagattatactgcattccagctgagaaacttgaagtgattaattaagactttgtggaaaagaacagactgaggttcaaacatgttgatttgaattatgacataacctttaagtggttaacaatttaaactgaaaatgaacaggtttaaaagtctatggagtttaaataagcaaggtagcagatcacataaaaattggtagttaaccaggtgtccgtggtggcccagtggttaggatttggcgctttcactgccacgggccaggatcagtccctgctctcaagagctgctcacaagcggcaggatcgggaaaaataaaaaagctagtcaacctatgtttggttctgacttctttaaatttgattctctgaccacatcttataatcactaggactgctgactgcagagtatgcagccaccttttaaaaggaaaagaactaaagttttcttttctaatatttatttttttggctgcactgggtcttacttgaggcatgcaagcccttggttgcagcatgtgaggtctagctccctgatcatggatcaaacccaggctctctgcattgggagtgtggagttttagccactggaccaccaggaatgttcctgtatttttctctttagatgggaactatatttttgatggtgaactctttctgcccataactaaactgagcaatactgctttggtttatcactcatttgacctgctgatttaagtctatgggttgctctcacagacatcatcaggacaattgttgaaactggaatacaaaactgtacattaaataatattttgtctatgttaaatctgttgaatttgttaacagagctatgataatgtaagagaatgcccttgctctgatgaaacaaatactgaagtgctttggagtaaaggaacataatacaattatttttattgtaatatgtaatattacatatcataatattttgttttaatattcaataaattttaaatattaaaattaatattaaattatcaacacaaataaaatgtttaatatttaattaaatattaatatttaaacattgaattttaatatttgaattaaatattgatatttattaaagttaatatgtaatattgtaatgctgataagtctcttcagccgtgtccgactctgtgcgaccccatggactgcagcctaccaggcttctccatccataggattctccaggcaagaacactggagtgggttgctatttccttctccaatgcatgaaagtggaaagtgaaagtgaagttgctcagtggagtctgactcctagtgaccccatggactgcagcctaccaggctcctccatccatgggattttccggggcaacagtactggagtggggtgccattgccttctcccaatattgtaataatttattgtaatatgtaattattttattgtaatgtttttattgtaattgcatttaaaataatgcaattattttttaaatgactcagaatatatatatatacacacacacacacacacacacatatatatagacagaggatgataaagcacctcgtggtagctgaaccaatgccagaaactgcctaccttccggtttcatatacataagaaaaataatctcctaggtcagttaagtaatttatactttgcggttgaaagtgtgctttactgattacttggctgacttcagttctctttctacatgtaaagaattataccacaaaactgacattctgaaaagagcaatggacttaagagtcccagtaacttacaaagtctagtcatttatccaaatcacttaactacttggactagttacttatgcaaacataaaaatcacatttgtgactagtgcattgtattgaatacaaagtgctacataagtatgggtagtttctaaaactgtgtgctttccccacttttatagctgtgtttaaaatattggctagaattcaaacttgtagaaactctttcacactggagttcttttatgttcattgtttgcttataaggaaatccctctgaatcaaaatttaaaccattttctacatacctagtaaaaggtagcaaattacagtcaaagctgtttttccagtagccacgtaccaacgtgagagttggaccataaagaaggctgaacaccgaagaactgacgctttctcggtgctttagaactgtggtgccagagtcccttggactgcaaggagatcaaaccagtcaatcctaaaggaaatcaaccttcactggaagaactgatgctgaagctgaagctctgacactttggcccccggacgcgaagagccaactcacaggcaaagaccctaacgctgggagagactgaaggcagaagggggcgacacaggatgagatggttggatggcatcaccgactcaatgggcttaagtctgagcaaactccgggagatggtaggacagggaagcctggcgtattgcagtccatggagtcacaaagagttggacacgactgagcaacgactgaacaacaattactcagaagcctttctaggttagtacctatttctggcttgtttcaggagacatcgacataacaacaaaaaaatttaacgtgccaggcagacacgatgcaaagaggtttacatacattgtgtaattttcacaaaaaggtactgcgtttgatgcaattattatttcatcataagtaaaatggggaaaacaatagcgcttacctcagagggctgttgtaaggattttaagactgtacatagcgcatttagtacagtgcctgacaaaaggaagggcttaacacacgtttaccatgtgctggtacaatcatttgccagataaaaacagaaacgcaagtgtaagcaaaaggatttttaactcaggtctgactccccaaggttctgcctctttaaaaaaaaaagaaaaaattatctccctgtacaggagggagaaatattaaatccccaggacagtggctgaacctaaagccaggaaacacacctaatttaattttgtcctcgactgttctcacccactaccgacgcctggctaaaagagctgctcgctaggttcttgaactaacaaaagaccagctttctaacctgggttaactagatctttctgaggtagaatttcctgagaaatttcggagagggtgtccccggctgcacacccgaagaggctgtccaggtcctgttcggggaaacggactcgtctcctccttctcaaaacaattttccgaggggcgtcgccctccaaaccactcggacttcaaaggtccccacctacaccggccacaggctacgagaagccccacacatctacggaggcgccacagcgtccttttcgccgcctcacctctccccgcctccctcctcccggaagcagtcctgcgcgcgccgcacttccgggagaactacatctcccagaatcccgctcaatcgacccatcttccgctccaggtgggggcggaggtggagctggtgccccggacggggtggggcctcccgaaagggctctagtcctcttgagaagactagggcctaaaggaaattctggggttctctggtaaggtaggacatctgtccctattaggtataatactgcccgccgcaccccgagggttccctctgtgtaaaacgcagatggtctagcccagcggcggagcttgccgcgggcctccaacggagacgcctgtggagcgaagggcagatggcgcacgcacgcgcagaggctcagcttggtagtgggagccgctgagccgcgtctgaggtgagtaggaggcggggcggggcggggcggggcggggcgtgtcgtgtccagcgtcgggactgacggctcccgcgggacggccaccatgggcaccatcaccgaagtcccagttaaacctgaaagtcctcgatcccaactgtccagaaattggagtccccgggaactcagttttagcatgtatacatcaaagtcctgttttcaatgaaaccacttcgagcatttcattgccattactttcgtacaagactgccttcctcttctgtatcgtgcgttttaaaaataatagttaacgtgttgagggggctcaccctttcatcttggtttttcgacttggagcgaatagctccttcctaacaagctgcagagcttaaaatcttttttgcacatttgattctattgaatttagtgtcagactagatacatactttggcgtgtgctctattatttcacatgtctcctcgtgagaagactccttgggacggtaaagacaatgatacattctactaaagatgtaatggtgccgatgaaattcatgatctgctggggatacagacaattaaacaagaggcttattgtgccctaaccctaaccattttgcttccaccttgttattggatttggttatgttgcttaaccttctgggtctgcattttctcataaaacgaaaagattggattagatgatctctgagaacttgccatctctaacatcctggggttagttagtgaggagtagaatctagatcgtatcgcaatatgttaatataagacatcatcaacttccatttttctgctaacataaatgaatcgtagctctgagaattttagcagcagcattagaaagaactgcccttattgtatgcgtaatctcatccatattgctgaaaataatgagtttagctgataatacaacttttttcaccctatatttgttgttttatagatcattgctaaggaagaactctgggtaccataaggaacacaacgtatgtgatgatggctcagatcttaagacctcatctgagaagtgcttcagtgattcctaatcgaatgaaaatgggtccatatcttgttgtcataagaactagaatgatgtcaactcataaatccaaaaggaatataagagaatattatgggctgctgaatctggatgaaggctgttctgcagatgatgtcagggaatcttttcgtaagcttgccaagcaataccatccagatggtggctctagtactgctgattctgcaacgtttataaggattgaagaagcttacagaaaggtactttcccacgtgatagaacagacaaatgccagacagagtaaagttgaagacacagaagaagaagaagaaaaattcaaatataaaacaccccaacaccggcattacttaagttttgagggtattggttttgggactccgagtcaacgagagaagcagtacaggcagtttagagcagaccgtgcaactgaacaagtgatggaataccaaaagcagaaactgcaaagccagtatttcactgacagtgtcactgttaaagatgtaagacacagtaaggaacgaaagataactcgggcaatagagcgtttggtggaggatctcattcaggaatcaatggcaaaaggagactttgacaatctcagtgggaaaggaaaacctctgaaaaaattttctggctgttcatatattgatcctatgactcacaacctgaacagaatattgatagataatggataccaaccagaatggatcctaatgcaaaaggaaataaaggataccattgatcaactcagagaggcaattttagcatcaaggaaaaaaacttgggaatccaatgacatcagcggaacagaaacagtgggaccaagtttgtgagcagtttcaagaagacatcaaaaagctaaataagcgaattaatgattttaatttaattgttcccctcctgactaggcagaaggtccattttgatgcacagaaagaaattgccagaacccaggaaatatacacaacccttataaaaataaaagaaatcacaaataaaaacccaaataacactgatccgggagaaggagagaaaacacctggagttaagacagttttctttaactggatgaatgtgtggaaatttattaaaatatgaccatctcaatgttcacagtactgccccaaataattttcagtaatattaacacacatagaggctgaggtttctttctataacacaagagtctgagaactgtgcacctctgtacttttcacaaaacgacccacatctccagtgatgtgtaagtgagtgagagaactgtaagaaacaaactgagtccgagaaatattcaaccagctttgttctgaagacatagcaagacaagaggaaacaatttaatactgacacttgagtttattaaagcacaaaactagtctaagacttttggaacattctctatatggttggaaatattacgacaggaaattagtgtaatggacttacagcactcttctcttcttttttttttataaaggccttctctgtgggtactgaataaagaaaccaccaaacatctaggttgtacttcacgctaacttcatgagccattggcagcaaagatccatcagccaagctaactgatttagctattctagaaatagactccaatgtccactttaaagagtttattttctgacctctcagaggtgggttcaatggaaacaaagtttcacttatggcttcatttctaatcagagtcaaaatgttttacagaagcctatctgaagcctctcttgtattacacttctcagaggctttttcaatgagagtaatatatcagtttacagtcttagggatccaatttcctgtgttaggaaccctttaataagcaactacaagatgtcagaattttgtgctcacttgcacctttggcaaatgagaagagattgacatccatgagactgtgtcccatccactctcagactgatctgactttttaagatctgtgtaattgccttattcacagaattgggcaactagacttgtcaaaagaagctggtctgtttccttatttaattcagagtgctgtactatggaagtgtctcagaagcatgtcacttgcccctctgattttggaagaacaagtgattttgtaaagtatgtgatagataagtaaaattacatcttcagaaggaaatttcagaccttgtgcttagatgatggggcattaatgggtataatatgtgattattttgttgaataagttatcactagcttctgcaatgatctattactctatatacaattgtgaccggtgtgaaataagagctttataataaatgctgttgctctaaaacattttataaggtgatgcttctgtgaatcttgttaaatattagatacatggcacctaattacaatacatgatacctaattatggggcttccctgatagctcagttggtaaagaatccgcctgcaatgcaggagaccttggtttgattcctgggtcaggaagatcccctggagaaggaacaggctacccactccagtattctgtatagaccatagggtcacaaagagatggacacaagtgagtgactttcactttcacttacctaatcacattacaagaacatacataaaggaaaccgtttttatttttggtttgctgggtcttcattgctgcttgcaggctttctctacttgcggtgagcaggggctattcactgtggggctcaggcttctcatcgtggtgacttctcgttgcagagcgcgggctctaggatgcgtggactgcagtagttgtggtgtgtgggctcagtagttgcagctcatggggtctagagcatatgctcagtagttgtggtgcatgggcttcgttgctccatggcatgtggaatcttcctggaccagaaatcgaacctatgtcccctgcattggcaggtggattcttacccactgaaccaccagggaagtccaaggaaatcttttttcatattagctaatgagaaggtaaggttatcagaaaactctagtaattcctaatttcagcacagcactttatgtttgtaaatgtctatattaataaatttaatcagtaaacttaatgattattcaatggtgcagtgttgtctaaacagctaacagtaataataaacatgtttttgtctgaccatctggatgtttttttatcttcttgcttgatgatgtcaaaactgacagacatggactcttcttgctaagaaagcaagttcactatgtacaaacagggtcacttactgaagtaacttccaggccagaaaaaaaatgtgggccagttcattggcatttgtggaatcagaatctgaacttaggctctgttttgatggagcattgacctttttctgttggtttttcatcatgtaactgtcagcttttcagatgtagtaataatttattgagatctcttaactcattaataggcacatatcagactcttgtctgattcccagccttttcatggctcctttcttcaaactgtacgacgaagaccctggcccagccccgcgagtagatcacaagtgccttttgtctccatgtccttgttctgtgtgcccgagtttggcctcagtcagtagtctggtccctcaggactatagttttaagttccttgacagaatgattgcatttttttttttcactttgagtaactctggccctttaatttgttaatttagtgataagccagttacatttggttctttgaataattgaggttaatcagatttctcagtgtaatgtaaactgagcaacaagtccacaaaatctaacactcccatgtagggtaataaagtctttgttgggtttgtttgtttatttaattgaagtatagttgatttaccaggttgtgtcaatttctgctgcacagcaaagtgattcagttaaacatatatatgtgctttttaatattcttttccattgtgatttatcccaggatgttgaatgtagttctctgtgctatacagtaggaccttgttgtccataccactgcactgtcgttcattctcttcacggtgctcccaggctgtagccctactcttggcggtacccctcccagagatgggagtcccctctggccttgtctgtatgactggggccatacttccctgttatactaactgcctggatacccatccctgggcctcagccaccttccaggacatttccagtacccctcaggcacaactcctgcttatttgcctgttcccagaagtactgcctttcctgttttcaacaaagttttattaattcaactacagttactgaagtcatacaaggcaatccaccatcccaccatctggattctcagaaatcccagtgactggggcgaggtgctacaaaaggaccccttacccccaaaggtggatcccactgggctagcattaaagtgcgagcagggcttcattcctcccgcggttctagggaagaatccgactccttgccttttccagcttctagaggctgcctgtatccctggcttatagccctttcttcttcttcaaagccagcaagggcaggtggagtccttctcatgtctcatcactctgactcttcctcttctgctttttgggacctttgtggtgaccctgggcttcctaagtggctccagtggtaaagaacctgcctgccaatacaggaggatgtaagagacatgggttcaatccctgggtggggaagatcccctggaggagggcatggcaaccccctccaatattgttgcctggagaatctcatggacagaggagcctggcgggctacagtccatggggttgcacagagtcggacatgactgaaggcacttggcacacactcacgtggtaaccctggctccacccagttcactcagcataatctcccccattttaaagtcagtttaatatatacacactagtgaaagtgaagaatccaactgtgtggatcacagtaaactgtggaaaattctgaaagagatgggaataccagaccacttgacctgcctcttgagaaacctatatgcaggtcaggaagcaacagttagaactggacttggaacaacagactggttccaaataggaaaaggagttcgtcaaggctgtatattgtcaccctgcttatttaacttctatgcagagtacatcatgagaaacgctgggctggaagaagcacaagctggaatcaagattgccgggagaaatatcaataacctcacatatgcagatgacaccacccttaatggcagaaagtgaagaggaactaaaaagcctcttgatgaaagtgaaagaggagagtgaaaaagttggcttaaagctcaacattcagaaaacaaagattatggcacccagtcccaccacttcataggaaatagatggggaaacagtgtcagactttatatttttgggctccaaaatcactgcagatagtgattgcagccatgaaattaaaagacacttactccttggaaggaaagttatgaccaaactagatagcatattcaaaagcagagacattactttgccaacaaaggtccatctagtcaaggctatggtttttccagtggtcatgtatggatatgagagttggactgtgaagaaagctgagcactgaagaatggatgcttttgaactgtggtgttggagaagacccttgagagtcccttggactgcaaggagatccaaccagtccattctgaaggagatcagccctgggatttctttggaaggaatgatgctaaagctgaaactccagtactttgcccacctcatgcaaagagttgactcactggaaaagaccctgatgctgggagggattgggggcaggaggagaaggggatgacagaggatgagatggttggatggcatcaccgactcaatggacgtgagactgagtgaactccgggagttggtgatggacagggaggcctggcatgctgcaattcatggggtcgcaaagagtcggacatgactgagcgactaaactgaactgaactcagtgaaagtgaaagtgtcagtcactcaatcgtgtccaactctttgcaatcccatggacaatcacccaccagtcttctctgtccatggaattctccaggcaagaatactgtagtgggtagccattcccttctccagggggtcttcccaacctaggtatcgaacccaggcctcccccatagcaggcagattctttcctgtctgagccaccagagaagcccatacacactactgcatataaaataaccaacgaggaccttctgtgtagcacagagaattctactcaatgttaggtaataacctatatgggaaagaatctgaaaataatggatattcatatctgtataactgaatcatcataaaacagcactgtgaaacaactatactccaatataaaaattgaaagaaagtcagtcaatagcaaccttattccacttgcaaatttagttttccgttgctgtgtaacataaaatattcagagattctggggattaggacatatgggggggtgttaccctgccaccacaattgttgagtcactaagttgtgtctgactctctgtggcaccatggactgcagcacaccaggcttccctgtccttcactatctcccagagtttgctcaaactcatgtctattgagtcagtgatgctatcttaccacaatatcctttcaaaaatttattttgaaatttttgtctgtgctgggtctttgttgtgccgtgcaggcctagttgctacgtggcatgtgacaccttagctccccaacctgtgtcctctgcattggaaggcgaattcttaatcactggcccagcaggtaagtccactttgaaaaaaaaatctgtacctggttgacccttaaacaacacaggtttgaactgtgcaggttgacgtatcttttctaaatttgtttatctactttggttgcgctgggtctctgctgccgtgtgcggactccgtctagctgtggccaggcaggggcggttctctggttgcagtgtgcgggcttctcactgcagtggcttctctcgtggagcgcaggcttgagtttcacgtgcttcagtagttgcagcacgggggttcagtagttgtggctcacaggcttagttgctctatggcatgtgggaccttcctggatcagggtttgaaaccgtgtctcctgcattgccaggtggattctttaccactgagccaccagggaagccctgtgtaggttcatttctatctgttttaggtttttcccccaataaatgtgtactacagtactgcactagccaagttggttgagactggcatgtggaaccaggatatggagggccagctataaaggtatgcttggatttttgactgcagtgagtcagcaccccaacccctgagttattgaagggtcaactgtatatgatttatagacacacactgtatctccattgctttctcaaaaatacatggattatcttcgtcttcacctgccttttaatgtatcttcaacatttttccaaatcaacacatatagttctatctcatctgttaagccatcatgagattgctgcatgcgctcatggaaagcagaactaatcaatactgagcaaaggaaataaatagcagtgcaaggtgacacaaagacagaccacaaggcattgagagggcaaatgcaagctgaagttatcacaaagcaggcacgagatacggtgtaacaacaagtcataagctatgagcgacagagaaggcaacagaagctcatgcttgttgaacaccttccttgcgttaactcacttaatcttcacaacagtcctacaacataggtactattattaacttttttgagagatggagaaactaaggcacagattaaataacctggcacacagccagaaagtggcggagctggggatttgaatccagactgactagagttggtctgattccacacccctgttcttacccacacaccgagctctggggttggtagggaggagatggagcagatcacattactgagtgaaaattctaacatttagttatttaggttgtaccaggtcttagtggcaacatgtgggaatctagttccctgaccagggattgaactcaggccctctgcattgggagtgtggagtcttagccactggaccaccagggaagtccctgagagaagattctagaactccatacactgaggttcccaggagccaccttggattcaatggggtttttgtttgttttcttaaatttttgtttgagtacagttgctttacaatgtgttagtttctgctgtacagcaaagtgaatcagctatacatggacataaatcaactcttttatttagccaaatatataaatatttgactgtactgggtgttcttgcagcatacgtgatctttagttgcagcatgtgggatctagttccctgaccagggatcgaaccctgaccccctgcactgggagttcagagtcttagccattggaccaccggagaagtcccatatatcaactctttttttagcttctttcttcatatgtgtgtgtgtgtttgtgtgtgtgtgtgtgtgtgtgagtcgctcagttgtgtccaactctttgcgaccccatggactgtagcctgccaggctcctctgtccatgggattctccaggcaagggtactggagtgagttgccatttctttctccatataggtcaatactacatatatattgagtagagttccctggctatacagtaggtaggattcagtgtgctttatagctggattattcttcttcttgaggtccctgcctccctgactccctgtaataccagtgagcaagaggaaatgtgatgtaggggagacgaaatgaatgagcttcagagttcgagagacttgaattcagatccaggattttccactcgccagctatgagaccttcctaggcatctatctgtcttctcttatcaaatgaatatcatcagactcaacttgcaggatagttgtaagcctttgagatgatgaacatgaaatgctggatgttggagggggacaggcgtgtgagcgtgcctacgtgctcagttgtgtctgactctttgagaccccatgggatgtagcccgccaggctcctttgtccatggggtttcccaggcaagaatactggagtgggttgccatttccttcgccaggggatcttctccacaggtattcgaccctgtttcttgcagggagtaaatcagtggttctccgcagatttgctgctgctactgctgctaagtcgcttcagtcgtgtccgactctgtgcggccccatagacggcagcccactaggctcctctgtccctgggattctccaggcaagaattactcagctgtaaatcagtggttttccgcagaggcattactgcccccccacaggacattatggaaagttgggggagaatctttagtcaacaagatgcgaggcactacttggacagcaaggagatccaaccagtccatcctaaaggaagtcagtcttgaatattcatttgaaggactgatgctgaagctgaaacttccaatactttgtccacctgatttgacgaactgactcatttgaaaagaccctgatgctgggaaagattgaaggcaggaggagatggggacgacagaggatgagatggttggatggcatcaccgactcaatggacatgagtttgagtaaactctgggggttggtgatggacagggaggcctggcgtgctgttcatggggttgcaaagagtcggacatgactgagcaactgaactgaactgaactgaacaggcagcccatttggaccagtatgtcacgctatgtgtatttatgtgtgtgtgctcagtcactcagtcatgtccgactctgcgatgccatgcactgtggcctgccaagctcctgtgtccatgggatttttcaggcaagaatactggaatgggttgccatgttcttctccaggggatcttcctctcacccagggatcaaacctgaatcccctgcattggcaggtggattctttacatgactcagctggtaaagaatccgcgtgcaatgcaggagacctgggtttgattccctggattgggaagatcccctggagaaggtaatggctacccattctagtattctggtctggggaattccatggagtatgcagtccttggggttgcaaagagtcggacatgactgagcaactttcactttcacctgggaagcccagtttgtcatgttggctggctggattggtaagtccatgcaaccctagttgctaagtattttaaacatcattcctgaccacaggcacttaagagatggggccagggacaccaggtgtttcacagtgtatggggtacttgaccaaaatgaggaattgttccttgtcccgctcagcattcaaacatcccaccagacattcatgtgggtgaatactcgcttatagtcattgaagcctaaaatgggattatattttacatataaatatgccaattttgcatgattttaaatacacttatcttttccccccataaaagcaactactgtgaaaattgtacttcattttcttgggaactcaccaagaattgtacttcattttagaaaaatgttaccaatggcaccatggcctgtggcatttgacttgccaatactatgtgtctgttggagtttgcatttgtagtgctaaagacaaatgtataccagaaatcagacacctccctgatttttggtttaaaaaatttattattattattattattttttgagatcccttttaatttagaagtaaatggcaccccactccagtactcttgcctggaaaatcacatggatggagaagcctggtaggctgcagtccatggggtcgctgagagtcggacacgactgagcgacttcactttcacttttcactttcatgcactggagaaggaaatggcaacccactccagtgttcttgcctggagaatcccagggacaggggagcctggtgggctgccagacgtctctggggtcgcacagagtcggacatgactgaagcgacttagcagcagcagcagcaaatgttattttagtaataattaatccaaaattaaattaatggagatcaaaaaaaaaattaatggagatcacagccagcatccaagacgacccctaaagatccccactttctgatattcacattttttggtgtgcgtagcattctcccacaatcggcttcccaagtggtgttagtggtaaagaacctgcctgccatcgcaggaagtgtaagagatggagggtcggtcgtcccttgagttgggaagatcaactggaggagggcatggcaatgcactctagtattcttgtctggagaatcccatggatagaggagcctggcaggctacagtccatgggattgcaaagaaccagacacaactgaaacaacttagcccacactcactcccacaacggcgcaaacgtcatggtatgctctgtgtgaccaacagaatagagcaaacgtgctgctatgtctcttctgaggccagaggcttcctgctgtctctctcagatcagtcactctgagtgaagccagttgccatgtcttgaggcagccttgtggagagggcgcccgtatccaggcacccgtatccaggaatcaaggctaccagccaccagccatgtgagtgagctttatgggaagcagagccttaggcgagtattcagtatttgcagccccagctgacagtttgattataatctcgtgaggaatcctgagccagaaacaagtcagctaagcttgtctcagattcctgagtcttaaaattgtacaagataataaataaataaatgttttaagttgctaagttttaagataatctgctgtatagcagtagataactaatagagaagacatacatgaaactcagtagtctcattcatcaataagcattgttttaaaaacattttgtatgtgctatcctcccagtataattaaagtcaatctatattataaaaattggagaggaaaatggcaacccactcctgtattcttgcctggagaatcccatggacagaagagcctggcaggctacatggggtccaggctacagtccatggggtcgcaaagagtcagacgtgactgagtgactaaacaacaaatattataaaaattacatgttgaaatgatttattaattttgacatcactctggtcttatactgttcccagaggccttttatcttttttttttttttttaatatttatttatttggctgcactgggtcttagttgaggcatgctgaatctagttccctgaccaggattgaattctgggctccctgcactgggagcatggagtccaagtcactggaccacataggaagtcccctacctaacttctttatgacttcttatacttttatactactgtatatttttctgactcattctttgttccgtaaagcattgaagaatttgtctccatatcagtattttaaacactggtgtctgaatatatccctgacatagagtacttggactatttcatcaccacctcttcctgtataggtgattattttaacatggctcataaaaaagcatgactcatttgtgagagtatcatacttctcattacctccattttttaaaaatcggagtataattgttttacaatgctgtgttagtttctgctgtacaacaacatgaatcatatgtgtatgtatatgtatatcccttcccttatgaggctccttcctatctcactgccatatctctatttaaactgagatcatatcctcttttttctgttctaaaactagttttttttctttttactatgctgaaaagccagtttgacattgttttttctgttatttgtaactgaaagaaaaccagctgataaatgtatccagtgtcatcagagtctacactttagaaagaaatgtttcctcttctgcttgaatcaaatgatggccaagttttggtatcctgtttccactctaaaagaccatcttttcacctacaacaaaacaccggtaccatgcttcatgttggtactgatcctctcattgttgtaggcagtaaatgtttcagttttgtagaaaacaaaaaccaaaagggctgtcttttactcagatgactgacactgcatatccatcctttcagaagagggtcacttgaggtccataggaatttgatccgaattctaagtccaaatacaaccgttctaacggacttactaacatgaagtctttctgtttcacaacccaataagcttatggtgaaagacaatatatatagagagagttctttttgtttagttgctcagtcatgtctgactgtgtgagcccatggactgtagcctaccaggctcctctgtccatggggatcaccaggcaagaacactggagtgggttgccatttccttctccaggggatcttcccagcccagggatagaacccgtgtgtcctgtaagtctcttgcattgcaggtgcattcttgaccgctgggccgctgggtaagtcccactgtgtgtgtgtatattttatatttacttatttcctgtgtcaggtcttagttgcggcatgtgggatgttctgttatggcacacagactctaattgcagcatgcaggcttagttgatccgaggcacatgagagcctagttccccaaccacgggtcaaacctgggccccctgcattgggagcttggagtcttaggcactagacgaccagggaagtcccagaaaggcaatagttttagaagtccactatgttttacacaacctagctcctgcagtactctttggtgtatatttctaaaagatgggaaatgaacgccatccgtcagagtaaattcatgaagcagcctcaagaagaacaaacgagaacccacgggacctggtgtgaagaacaatctagatcgcttctttctcttagtaggcttgaaccacctggactagattctacctgtctaggtttaggtggagtaggccctttagaactcgtcctggcccaaacttgaaaatggttctgaagtcacaaagactccagaatctaggaaggtaataggaatttaagaaaacatatgcttaggtagttacagaattgaataccacctgatcagggcatgtgtggagatttttttaaagctgatttgcaactttttgtttttcagtcgttcagtggtgtctgactctttgtgaccccaggcactgcagcaagccagccttccctgtccttcactatctcctggagtttgctcaaactcatgcaactttactaaagatttaaatcagtacatttgaaatgcaactctgaaatgttgacattagtaatttaaccccaatagctttcaaatgcctatattttttgaaagctctatacatgtttgactctctgtgaagtaaaagcttacaggatgatagagaaacaagctgcattagtgtgagtcccctctcatgtctgggaaggcagctcaaagcatgtgcatcttaatggtaggtcaacagtaacatcttcatagatatgtgttttgctcatagatattcctccgtaatcaagtttaaaaatctcgggaaatttttttttttttttaaacattcatttatttggctgctctgggtcttagttgcagcatgcaggatctttagtggtgacatgtgggatccagttccccaactagagatcaaatttgtgctccctgcattggaagcacagagtcttagccaatagaccactaagtaagtccctcagggaatctcacaatacttagtactttcaacagtgatgagatttgagaccatgatagaagctttgacttgtcccccaatatctcttcatcctttttcctcagtactgaaactgcatgttccagcttcccctgtagtttagtgtagctaggtgactacgcttttgtcagcaggatgaaagcagaaatggtatatataaacgttgggaaagtttcttaaagagaatacatgttccctttgtcctctcatctgctggtaggaatgtaagcataatggctagagctccagcagctctcttagaccatgaggtgacattgggaatggaggctggtatctttcaaatgcccatgtacttgatagcataaataaatacatgggtgactttcttggctggaataaggaggctccatctgtccccataaagtaccagagcagctctagactaactttggacttcttaaacatgagagggaaataccaatttttgtttcagatcagatcagatcagtcgctcagttgtgtctgactctttgcgaccccatgaatcgcagcacgccaggcctccctgtccatcaccaacccccggagttcactcagactcacgtccatcgagtcagtgatgccatccagccatctcatcctctgtcatcccccttctcctcctgcccccaatctctcccagcagtcaactgttcgcatgaggtggccaaagtactggagtttcagctttagcatcattccttccaaagaaatcccagggctgatctccttcagaatggactggttggatctccttgcagtccaagggactctcaagagtcttctccaacaccacagttcaaaagcatcaattcttcggcgctcagccttcttcacagtccaactctcacatccatacatgaccacaggaaaaaccatagccttgactagacgaacctttgttggcaaagtaatgtctctgcttttgaatatactatctaggttggtcataactttccttccaaggagtaagcgtcttttaatttcatggctgcagtcaccatctgcagtgatcttggagcccagaaaaataaagtctgacactgtttccactgtttccccatccatttcccatgaagtggtgggaccggatgccatgatcttcgtcttctgaatgttgagctttaagccaactttttcactctctactttcactttcatcaagaggcttttgagttcctcttcactttctgccattaagggtggtgtcatctgcatatgtgaagttattgatatttctcccggcaatcttgattccagcttgtgcttcttccagcccagcgtttctcatgatgtactctgcatataaggtaaataaacagcgtgacaatatacagccttgacgaactccttttcctatttggaaccagtctgttgttccatatccagttctaactgttgcttcctgacctgcatacaaatttctcaagaggcaggtcaggtggtctggtattcccatctctttcaggattttccacagtttattgtgatccacacagtcaaaggctttggcatagtcaataaagcagaaatagatgtttttctggaactctcttgctttttccatgatccagcggatgttggcaatttgatctctggttcctctgccttttctaaaaccagcttgaacatcaggaagttcatggttcacatattgctgaagcctggcttggagaattttgagcattactttactagcatgtgagatgagtgcaattgtgtggtagttttgtttaagctagtgttattttgtggttgtttccccctgcttcttgcagccaaatctgatcctaatacaataatcaaaaaagaagcaagacttaaaaacagtattatttggccatacttgacggtttgtgggatcttagttccccagctagggatggaactcaggctggcaatgaaagcactaaaccctaaccacgggactgctggggaattccctacaaacttgtttttaaaagtctactttcatagatcagcaattcaactagttttaaggttgcacatattgtattgtatattctgtaggaaatttagagggacagagcttgcaaaatctgttgaaattacactgaaaattcaagatgtaacatctttaaagaagacaggaagagacctgactgtaagaaaaagaaaaatctggatgcccggttaaagcatcaggatagaatcagaagactagtcagttgttttggtaaccatgggtaacagtactcgttggtagcctcggacaattaacttcacctttctaggcttccatttctgagtggttgttgttgttcagtggctaagtcatgtccgactctttgcgaccccatggactgcatgcagcacgtgtgcttccctgtccttcactatctcccggagtttgctcagactcatgtccattgagccggtgatgccatccaaccatctcatcctctgtcgtccccatttcctcctgccttcaatctttcccagcatcagggtcttttccaatgagtcgactcttcgcatcaggcggccaaagcactggagctacagcttcagcaacagtccttccaaagaaaattcagggttgattttctttaggatggactggttggatctctttgcagtccaagggactctcaagagtcttctccaacaccacgggttcaaaagcatcatttctgagtggtggggattagaaaaggacatctctacaggccgcagtttccagagaatccttcaggaccacgtgccctacacttggccaacgccgaagggcctataggcaaagagagcccctgcccccgggtcccgggataccctctgcacgcgatctcacggatgctacaattggaagttcctgagcagagacgcagccgggttgccacccagaagcagacctcgggaccggtcttgtctacgcatccgcgaatcagaggactcggaccctggcgggcggcgccctagctcagacccctggcgtcaggacccacccccggagcccagcccccgagccccgccccgccccggccggccacttgctgcgcgcagattggctgccgcggtgagcacggcgccgcgccccgccctgccggcgccctcagcctagcgccggtcgagcgctcccctcccggggctgaggtggcgcggaagacgccggctcggccgcggcgtggccgcctccgcctctgcgtgtgagcccagggggtcggcctgggcgtcggggaagccgggtgagtgctggcggcccgtttcgggggcgcgcgaggggaccagcgcccgcctccgaggcgcagggaggcacccttggcccgcccggggcctccccggtgcgctgcgccgccgccgggcgtatcggggtccgtggggcgtcggggcgacgccgcccccttcctcaccagcccgatccggcgaccgtggccggcgctcgggggtcggggtcggggagagccgcgatctctcgtcgtcgggttggttgccctgaaaggtttccatctcggaactgtcggctttccggcgttgcggggaaggggaaagaggtgcaccggcgcggggccccgggcccctcaggggcttcttcgcccctcttcgcgttggctctgaacccttccttgctgagaatgtggtccgtgttgagtggacttttccgactctgtacagaggtgtggcgtggagatggaggaggatggacattctttggaggattgatcgtacagggttgggtgtcctttgagaaacagagcagctcgtgtcgcaaaggtagttgcactggggacggccgttctcgtttttaagcaataaattgactctccagttaatcatgggaaggtgcttaacttgaaaggtaagtacgtgacctaaagccaaagcgctgatgatgagaagcactgtcctcgctcccgccccgttgctgacgctgtgtgtgtgtgtgtgtgtgtgtgtgtgtgtgtgtgtgtgttggggaaggattgttggggaaggattcaagcctcgtgtgtgtgtgtgtgtgtgtgtgtgtgtgtgtgtgtgtgttgggcaaggattcaagcctccgattggagtgaatgtgtcgtcagtcttgtgcctctcaaagaccttgatttctcttcgcagtgtgccacctcttctctcaaactcctcacctacccgcactgtaacaccccttagcttcacaattcccaagccccggactctcaggcttgtcacacttcttttccatcatcttcagacacttggtcatctctttttgcaaacatagttttcagacgtagaacaaacattagactttttttttttttaaccgataatactgttgcaagcctctttgtccttaaaaagaaaacccggagttatcttgagtatcggtgaggcaggaaaggctggtttaatgacagcagggggagggcgcagtgttcctcttccggagacgcgctttccccacctccatcctcctccgcccactaggattagggcagccctaactggctggtcatttctgaattcacttctggactccagggtgaagaatttatcttattttatcattatcaactcctttaaacgattaccgtaatacattcaggttgtgaactttttttttttaacattacagaagaacatcaagtgaaaaattgaaaccagggaatttcctggcagtccagtggttagagctctgcgcttcccctgcagggagcagggattctcttcctggtctaagagctaagatctcaagtgccaaaaaaaaaaaaagaaagaaaagaaaagaaaaagaaacagcacagaagtgtatcaagtaaaaggttagcataaattagaactccttgtttctttactttgcaccctcaattccagtccctaggaggtgatgtgctgtgttaagtcacctcagtcttgtccaactctttgtgagccaatggaccatagcccacaggctcctctgtccctgggattctccaggaaggaatactggagtgggttgctctgccctcctccaggggatcttcccaacccaggaatcgaacctgcaactcttacatctcgtccattggcaggcaggttctttgccagtggtgctacctgggaagccccaggaggggatagtaccatgatactgttgggcaacctacttaatataaggacagaatcatatcattgtggatatgcctcattttaaaaatgctgtaaagcacgtcactgtctagaagtactttaatatattttattggccccttattggtggatgttttggttgtttctgagttttagccattaaaagatttactatgtgaatatctttgaaaattgtaggataagtctcagatagtttaaacggattattgtattttagagtataattttcatgctcttttcacgtggaatctttttgtaatttgaaggactttacaatttaaagacagtagctaggcaaaactaatacaatattgtaaagtttaaaaataaaataaaatttaaaaaaaagaaaaaaaaagaaagacagtagctaatttgtttgatttaaatgcatttcttagtatctgtgtgtcttttagtatttagagactggatcaaaaaatttgttgagtaccgagttagataatggtgaattttttaaccttgttgccacatagtggtgttgactttaaggttatattgactcacttgattggcttagtaggaatgaatagagggccctgaggaagggaaaatgtgaacaggtatgttgtgtagtaccctcctgtggtaatccccctggaatatacagcagtaactggaattcttgttctcttttgaaataacttccttttgttgtaaaaggtatctcgggtatggagaatgttgtggggaataaatactgttgcagtgatcagcactgtatctacaaccacattaagaaaggagacatttacatctttcttccagagggagcctctgtcgtgctagaagttaatctttctcttgctttatcaaataagcattacacacaaatccataaatatacacatatatgtatatgtacacacatgtaaatgtttacatgttttaaacagtatatttagttttgagtgaatagtgttaaaaacatattacatacaaatagcatgtttcaaagttttattttactgttactgagagtgctgccaagaataggttttttaagagcacttaagaaacagatatctatgtagtccctagagaaaggactgtctcaataaaagtgctgagttggatataattggttaatgttccagagggcaacaaaatcgtaatacctttgtgatgaatcatttctacaaggctataatgatcataccttattaatttttgcagttaagcacaaaccttataggatgataaactgtgtctttattaacagtggattgttcattaaataaactgagataaggaaattatttccccaagagcccagatgaggtcctaacaggcttattaaaaaaaatgctagtgctttctccctttgagattaaaattttgtttcgtaattgcgagcacaatgctgaccatgtaaggaaaggacaggatttattgtcactttgagatgaacgcttccaggaaaaatgagggagacagaacagcttcagcttccttgacttttccccacaggagccctttctgaaggggtcagtggacagtgttctgggtgagtcttgggagacgtttactacggtctcaggggatctgggaggctttaatgtgaagcgaacactggaaggacagcagagatatggtcagagggcgtggccggctctctgtggcctccctgcagttaccagggtaggtcaaagcagaaccttctgtcagggaagtgcgtgtcctttgctgatgctggctgcaggactccgaaagagaacaggaactgcctcagtgtatgatcatgatccagccaagcccagctgaggacggattagtaggagtctgggccaggttcacggcattcagtcctcaagtgaaaaagctggcggagcagtgggacctcgcttcattccagcaggttgtccaagtctgggggccctgcggggctctcgtcagctctcctgtgtggggatctttcctgtattctcttttgttgcttttcactcactctgatggcactcagacagcagtagtctcctgacaaggaaaattatgattcctgatcctttgtgaacctttttttgttgtttgtttgtgttttaatttccgcagactgttctctgctttgacttcagtgatttgtcggcttccctaattgctccgtgggtaaagaatctgcctgcaatgcaggagatgcaggttcgatccctgtgtcaggaagatcccctggagaaggaagtggcaaccccctctagtactcttgcttggaaaattccatggacagaggagcctggaggtctacagtccatgggatctcaaagagtcagacataactaagcacgcacacacacacattttctgctttgacttcaatgatttgaaatttaaaatagtctgtcttagtgtgggtctattttcatccattattttgagtatctgatgggccctttaaatcagaaaatacagttcttcctattctggagaagttttcctgaatattttgttatttttctccctcatgttttctctgtagttcctcctgaaacacctgttacttggatgtgagccttgtaaaggtcttctcattttcttacctgttttcttctgttttccatctacttacggctagattttcttaacttttacttcccaaactttatatttggatttaagaaaaccccatggttatacttttaatattcaaaggctattttttagtctctgagtgttccttacgataacatgctgttcttgctttaagatgcagtatgttctcttgtttctgaggttgtaatgattttaagtttcccttctctgcgtagctttccagactcttgtctggaagggatctagcttcagtctcctgcactagaacagaggaatggcaaacttctgtccagttttcaggatgatgcctgagtctgccattgtgcatggtatccctcagtccagaaggccagatgtaggggaaaacctcagacttctatctggatatggatgaggcagttgccgggccatggagggcatagcaacccactccagcattcttgcctggagaatccccacagacagaagagcctggctggctacagtttgtaggatcgcaaagggccagacatgactgaaagaccgagcaaagagaaaagggacaggttctgggccctaacttgttttcctgcctccctcaagtctttaccgtgttggttctcagctttccctgctactggcttggacgtccagctttcttgggcatgctcagtcagtgaccatggtccatctgctttgcaactttcaaaattttactgctcttgtctcttctgttctcatcattgtgttcacgactccttttactgattgcagtttttagtgatgtttcaggagggagcaaaatgagatgcttggatacatcttcacccaaagatagtaatagttgtttttgaccaagtggtaactgaaactccaatactttggccacctgacgcgaagagctgacttatttgaaaagaccctgatgctgggaaagattgaaggcaggaggagaaggggacgacagaggatgagatggttggatggcatcactgactcaatggacatgagtttgtgtggactccaggagttggtgatggacagggaggcctggtgtgttgcggttcatggggtcgcaaagattggacacgactgagctactgaactgaatggcagtactgccataaacagaaggccgtcttcaaagcagtcctatgtttgtgatgtttgtgaaccctcttcttggtgggtagtggttgatagcattgagtgagcccagtgttctggcctgtctttttaattctcacttatcgagggacgtgctgtcatatccccagtttacacatcagaagaccaaaacctagggatatttaaagcttgaacagttgtggactccgcaggggaatgagggggtaagacaaatggagagtagcattggcatatatgcgccatcatgtttaaaatagacagctagtgggaacccgatgcatagcgctgggagctcagcttggtgctccgtgatgacccagagggtgggctggggatggggagcttcaggagggagggagtatatgtatgcttatagctgattgccattgctgtacaacagaaatcaacacattgcaaaacgattatcctccaattaaaaaagaaaaaagcctgaacagtgccagtcacatagcaactattccattaaaaatggaattaaatgagcctggccaggaaggcacagctgggaagaggctgatgtaggcgagggcccaggctggtgctcactccatggactgtactttcagctgcctgggtggtggctggcgctggaggagggtaattggtgtctaggcgtctacttcctttgtgccctttggcaacattcttactcaggtctttacctgcccattactgtttgccaggtgggttccctttcacctacttgggttcagagctgtgacccggggccagtttccctgaacaggggaggagagcattttctgaggaatctcagaggactcaaagattcccaggcagggctcctgcggggaaacctgggtaaaggtggcttccgagagtgagtgatgttttcctgtggctagatcagctctggggttgtgtagcagtcatcttacttaggtagcaactcatgattatctgccactctatttttttccagctttttattataaaaaatttttaaacatacagaaaaattgaacaaaagatttaacattttgccatatttgtctcatttttttctttttctttgctgaaccatttgctcatatgttgctgacactgacacctcacccccaaatagtaagcaagcatctcctaacaaggtcattctctttacataaccacaattctgtaatgttctctgacctgtattctgatttccccagttggcccagagtgccttaaaagtttttgttttttgaaatgaggaccagtaatggcttacacatttcacttggttggttaattgtattttttgtcatagatgagtttaatggtgaaatcttttgaaccttctagctcgtattgcttttggcgactacttcatgactggaaagatgatggttctcagaatcttcgaaatggaggggacccttgatgtcatctggttcagttatttccgaacttggcttctgtgtgtcctaaaagttgaattgggagtgtgtctgtagacaaagagatgaagagccattccaaggacatagatatatagaaatagatacagaaatatatacatgaatatattgaaaatatctaacagtttgcctaacagtagtgtttggtaagtattggctgtcttctcccttttatttctttgtgactggagtgaagagtgcctcaggatagtaggagataaggaagctatattagggagagactgtaagtatcctgtgtcatttggctttatcttgagccattgaaagttttacaataaaaggcatgatcccacctgagtttgtttttaaactactttttttttccttgactgtgccgcacggcttattagatcttaattccccagcaagggagcaaaaccatgcccaagtggaagcagggagtcttaaccactaggcttccagggaagtccccccaatttgagttttagaaagttctggcagaaaatggacttgagaaagcacagaggatggttttaagaactgatatgcttaaatatattgtcatggcaagattttatttccttcactgaaataatgctttttattaccagtgtttacaaattatcaatttaaataaatctagggcttccctggtggctcagaggttaaaatgtctgcctccaatgcgggagacccgggtttgatccctgggtcgggaagatcccctggagaaggaaatggtaacccactccagcattcttgcctggagaatcccatggacggagaagcctggtaggctacggtccacggggtcacaaagagtcggacacgactgagcgacttcaccttcaggtataaagtagactcttctttttttggtgacaggataatgagacatgtattgcatttcagagtttgaaagacagaatatttagattcagtcattcagcaagtattggagtgccttctttatgccacgtactgtgctaagctctgggagaaccacagtgagcaaaaacggatgtgggtgtcctttgtggagcttactttcttcagagggaggtaggtattgatcacatagaagattaatactgaaatgctaggggaattagatctggccatggagtcaggagagcatggaagccgttatcatcatccacttggattatttcaacaaccttttaactggtttcgctccttccactcttcccccagcagtctgttctccccacaacagcctaagggatgcttttaaatgtttggcagacttctcagactcccttgctgctgctaagtcgcttcaatcgtgtccaactcctagcgaccccatggactgcagcctgccagcctcctctgtccatgggattcgccaggcaggagtactggagtgggttgctattgccttctcccttagggctcccaattttaatcagtaaagacgaaagttctcacagtagcctgtgaggctaccctgttacctctctggtctactttcccagctcactgactccattgcaacctcgcctgcttccgtgttgctccttgaataacccgtcctgccctggggcctctgccttgctgttgttctgtctgatactcacgaggctaactccatgccttcaggtgtcatcttttcaagggggcctaccttgtccaccagtttgacctttcagctggccccactctcgtccacactcccagtgctcctagtctgctttgtttcccgcatggcatttttcattttctagattagatcagatcagtcgctcagtcgtgtccgactctttgcgaccccatgaatcgcagcacaccaggcctccctgtccatcaccaactcccggagttcactcagactcacgcccatcgagtcagtgatgccatccagccatctcatcctctgtcatcccccttctcctcctgcccccaatctctcccagcatcagagtcttttccaatgagtcaactcttcgcatgaggtggccaaagtactggagtttcagctttagcatcattccttccaaagaaatcccagggctgatctccttcagaatggactggttggatctccttgcagtccaagggactctcaagagtcttctccaacaccacagttcaaaagcatcaattcttcggcgctcagccttcttcacagtccaactctcacatccatacatgaccacaggaaaaaccatagccttgactagacgaacctttgttggcaaagtaatgtctctgcttttgaatatactatctaggttggtcataactttccttccaaggagtaagcgtcttttaatttcatggctgcagtcaccatctgcagtgatcttggagcccagaaaaataaagtctgacactgtttccactgtttccccatctatttcccatgaagtggtgggaccggatgccatgatcttcgttttctgaatattgagctttaagccaactttttcactctccactttcactttcatcaagaagcttttgagttcctcttcactttctgccataagggtggtgtcatctgcatatgtgaggttattgatatttctcccagcaatcttgattccagcttgtgcttcttccagtccagcatttctcatgatgtactctgcatataaggtaaataaacagggtgacaatatacagccttgacgtactctttttcctatttggaaccagtctgttgttccatatccagttctaactgttgcttcctgacctgcatacaaatttctcaagaggcagatcaggtggtctggtattcccatctctttcaggattttccacagtttattgtgatccacacagtcaaaggctttggcatagtcaataaagcagaaatagatgtttttctggaactctcttgctttttccatgatccagcggatgttggcaatttgatctctggttcctctgccttttctaaaaccagcttgaacatcaggaagttcactgttcacgtattgctgaagcctggcttggagaattttgagcattactttactagcgtgtgaggtgtgtgcaattacgtttattgtgtcgttcccatctcccttctttctcactgccaaagctccacatggccagtgctttttatcttctcattcttgtatcttaagtgtccacagcagggcctggcgtgtagctgtcactccttaaataaaccttgaatgaatgaaaggaaagctgatgtttgagtggagaagtcacaactaaggggacatctggcatcatgagtaggagttaaccaggtgagctgggggtggaaatgtaggtttcacgcggagaggatgtggtttatatggggtgattcagcaagtgtaaggcactacaagaaaaacgaggatcattgggagagagaggagaaaatatttcaagagcagcttgaggagaaaaagtgctgggccgtgctacagcgtctttgtctttagaaatggaaagacggtgaaaggttttaagcagggaggagatgccagctttgtgccttttaaaagcaacaacaacattctagctgtggtatggggaacatattgatgagggcacgatgggtgaggctggatcagttgggtacctgttgtcatgggacaggtgggagagggacctctctccatcactcaggtgatggtgctggaagggagacgtggagaagttagacttgagagagttaagtgaaagttgctcagtcatgtccaacacattgcaacgccatagactatacagtccatggaattctctaggccggaatactggagtgggtagcctttcccttctccaggggatcttcccaacccagggatcaaacccaggtctcccacatcacaggcgaattcttcaccagctgagccacagggaagccctgagagagttaaaggaggcacaatcaggtaagggatgtgagaggtaagaaagaagtaaagaggaagacacctgaatttctggcttatgtaatcgaatgactggtgattcattaattgtgagaatactggaataggatcagatttggaggaggggaccatgcatttgaatttgtgtttggacctgctgattttgaagtgactgagacagccagagggtgtcaggcaagtagttggatgtatggaaacgtaaatctgtgaatcaactgcatagggaggcagtatagggaaggttcaccattttgaataattcatgttttgaataattaaaagttgttaaggatattactggggcaaattgtatagctacaggattagagtctccttagaaacctaagctccctgtcctttactttggcttttagttttaaatcttttaccaaaattgatgctacttcctaaattttatttctgtttaatagatgatttataggtgagaaggcaaagaagcatcctgagattaagtatgtaaaatgtcttttccaaaagtgctttagctctctgaataattcattctgttggatcttaaggcctataaaatattcacactgtgagtgcccagaaaccaggtttgtagcaacccaagaagagagcttgtattctccagactcgcttggcaagatttgaatcaacactaatcacactgtcattgtggatctcattggatggctttcttctatttctgggtggtcacagggttcctgtaaattggggccctttctcttccatcttgtttttcttgctctcttcaccacaggcagtaggatagtaacttcctgctcaagaaaccagaaatgagaggaatgctgtgaatctctctggcataggtacagtgtaatggtcacaaaatgggttttggaatcagatgtgagcttcagtggaatcctggctttccttcttgctagctgtgtgaccttgggccagttcttctctaaacctttttttagtaataccatagaatcttagtaattgccttagagtatttgtgaggagtcagtggaatagtctgtgcaaagagttcctccgaggatggagtggagctgtctgtaactgataagcaccttgtaactaatagccagtagtagtcatagaggtggggagatgtatgttttactctgtatgactcttacacgtttagtttgaccgcctcgtgaagcttgtgggactttagctccccagccaggggttgagcctgggccctcggcatttgaaagcacagagccctaagcgctggaccaccagcgaattcccatagattttatttctgtctcttttgagtcagttgtctgattatgtagacctactatcttggacagtatttaaattttgttaatttcctgatttgggggtgagggggtaacagttttgttgtgttttttttttacaaattgtaacgatttaaaaaacatctcagttgatttctctgccagtttgttcacctcctgatgatgggtgccaagttttattcatctttgtttttcccacagtaccttgcttgtaagacatgttctgtaagtactccatacatgttctagaggagttttgttctggttaagtcccactgtgtgtagtccgctgtgatgcctggcacacagtgatgcaaggaaggaaggaagggagtctcagatgagcactgagtcagtcctccgccctcttccgcgtttcctcctccagatacgctagctgtgcccatgagttcagctaccacttaatcactgcaaacctccagcctctttttctgtcttaaaccactgttcctctgtgcatgtctttggcacctctccacctgcaggcccttcatcatttcaagcccattatgctcaaactctcccattctcccttccctgtttcggttagtggtgtcttgccaggcattgagcacccaaacgtagtcatccttagctcttgcttgcttgtggataataccatgctagtatttctcaaacaaaacccttttctttagcctgtaccagtctggcctcagttcatatccttattctctttctgtctagaaggtgtctttaacatactccttcagtcccttctccatactcctgctcccagaattatctttcaaatcacagcactgatcttgtcttccctgcttacaagcctctggcagttccctagttctcaaagcaagggcctacagactccgagctgtgggccaggtctggtctgctgcttgctttgtaaattaagtattattggaatacaggcatatgctcatttgtccacatagtgtctgtgctgtataacagcagagatgcatagtcctggcggagatcgtttggtctgcaaagccaaaaatgtgcactctctggttctttacagaagaagttggctaatccctggcttcgagggtagaggtcagatttgcataggctgaaaaagtcttcttgatcttgttccatacaggttaatcaccaccaccactctttgaaataccataaactctaccctgttttcttgtgtgcctacatgatttcacatattttattccttcttttttatctatcatattcctattgttgcttcaaaactcagccaagtttatttttcctttattaaacttccctcaactcttcctggcaactcttctgtaacactgtttttatatttctattataccgcttttatgttatagcccataggttatgtatatttatagcacatttactcttctgacaatgtcccctaaattctttacgttgattgtggtaatcatttttgtatacacagcacctaacatcatttggcaactagtgcaaagatagatgaacaaacagatggtagtatgaaagtttggtcaaaggaaagaattttgaattttgggacttgggtgtatatggaaattgttcagaccatgtttatatattattcaagtgtttgttgttttctcctcttgcctttttcagctgtcctttggtttcctaaactaactgtttggaaatgaaaatttcacaatagaatcatttaaaatgccctctaaaaagggctcatttctgggaattccctggtggtccagtggttaggattccgagcttccacttaagggggcataggtttgatccctggttggggaactatgatcctgtatgcggcatggcacaggcaaaaaaacaaaaaaagactcatttctttttataaagagttaccttttaggagtggcaataatgactgtctaatgtctatcaaggctatggtttttccagtgatcatgtatggatgtgagagttggactgtgaagaaagctgagtgccgaagaactgatgcttttgaactgtggtgttggagaagactcttgagagtcccttggattcatggggtcacaaagagtcggacacgactgagcgactgaactgaaatgagctgaactgaatgtattagaaaacttcctttagttcagtttaataatcttgttttttaaaaattgctaccagggtcagttttatgggagaacataccggtaatttccttgacctcaaaaaagtttgtttattaaacatagttatagacatagtacatcatataagaggttttcaacaggcaagaagaatcaacaattcatagttttaattacagtgttaatgttaaaaatcactttgcattaaaaaaatgtaattcatgctcagtgcagcagactttgaaaatagactatttctatttctatctatgtatggatacatacatcatccatatgtataatgatattacggaagtactggtgtttgtcgttctagcatttttacacatgtatgtgtttatactgctgattcttttttctaaaaaggaaataatgcaatagatagttttaataacctgcttttttcacttagtcattaccatttactcctgccattctatgtttttcagaaataaatataaaaaaagtttttttcacatggcatgtgggatattagctccccaactagagatgaaacctgcacccccctgcattggaagcatggggtctcaaccactggaccaccagggaagtccctcaaaaatacttttttaaatgtctgcattaacgccaaagcctttgactctgtggatcacgacaaactgtggaaaattcttcaagagacgggaataccagaccacacctgacctgcctcctgagaaatctatatgcaggtcaagaagcaacacttagaactagacatagaaaaacagactggttccaaattgggaaagcagtacatcaaggctgtatattgttaccctgtttgtttaacttatatgcagagtacgtcatgtgaaatgttgggctggatgaagcaaaagctggaatcaacatttccaggaaaaatatcaataacttcagatatgcagatgatgcctcccttagggcagaaagcgaaggagaactaaagagccttttgatgaaagtgaaagagtagagtgaaaaagttggcttaaaactcaacattcagaaaatgaaggtaaaggcatctggtctcatcacttcatggcagatagacggggaagcaatggaaacagtgagagattttattttcttgggctccaagatcactgcagatggtgactgcagccatgaaattaaaagatgcttgctccttggaagaaaagttatgaccaacctagacagcatattaaaaaacagagacgttactttgcccacaaaggtccgtctagtcaaagctatccagaagtcatgtgtggatgtgagagtggactataaagaaagctgagcaccgaagaattgttgcttttgaactgtggtgttggagaagactcttgagagtcccttggactgcaaggacatccagccagtccatcctaagggagatgatcagtcctgggtgttaattggaaggactgatattgaagctgaaactctaatactttggccatctgatgcgaagagttgactcatttgaaaagaccctgattctgggaaagattgaaggcgggaggagaaggggacaacagaggatgagctggttggatggcatcaccgactcaatggacatgagtttgggtaaactccagaagttggtgatggacagggaggcctggcatgctgtggttcatggggtcgcaaagagtcggacacgactgagtgactgaactgaactgaactgatgccattttatataagggacttcagtgtccacagattttagtgtccaagggtagtcctggaaccaaaccccctgtatataccgagggatgactgtatgttttctgaaatgaattttaaggagactatttattcggctgggtcaggtcttagttgcagtatgcgggacctttcaggatctttcactgtggcgtgctccttcgctagctgtggttccccaggctctgggccgaatgggctcagtagttgcggcatgcagacctagttgccctgaggcatgtgggatcttagatccccgacgagggatcaaacccacatcttttgcattgaaaggtgggttcttaacccctggaccactgggtaagtcttgggaaatgaattttacaataagaagtacgacttttgttttaaccttcagacattgtcttaaattcatggtgaccttcccctaaacttgctttttaactagttaatgtttaatctttgataacagttcatctccatgtctgcagactatcttgatgaaacatacccataatgcatacagagtaagtctttagtgcagctaaagcatatctaaatgataaaattaaaaaataaaactgcttgtaggtaaaatttacatactgtaaaatacacagctcttaagtgtacacttcagtaacttttgataaatacatgtacctgcataatcagtatctcaaccaagatatagaccatttctatcactcccccacaaaaaaaagttcccttgtagtcagttctcagtccctgtaggcgatcactgttttgatttctgggaacattggttagttttgtctcttaagcttcatttaaatagcatcatacagtatatactcttttgtgtctgccttttttcacataaatcaggtttctgaggttttttttctgtgtggttatatgtattattcatccttttttgtccctgaataatattccattctatggattgatcataatttgtttatccatttgtttttctgttaagcatttaggttgtttcagtttggaactaatatgaataaacctgctctaaacttgcttgtaaaagtctttttgtgtatgtggacatatgtttttacttcccttggtaaatatttagaaatggaattgctaggttataggatggtttatttttaactttgtaagaaattgcagtcagaaatgtgtaagatttccaattgttctaccaccaacagtcaatatttttaaaaaatcttagctcttctagtggatgtgatacttctttaatttgcatttccctgatgactgatgatattgaatgctttttaagatgcttttgttcattggattttaattaatttatttttggctacagtgggtcattgttgctgtgtgaggactttctctagttgcagtgagcggttagtcaggtatttaagagagtttatattgcagtgtttggggctagctgttggctgggccgccacctggcactagaccagaacacctatatgtggtctgctcacagtaccatggccttggatttttcatgaaggaaccaggactctggtcttagtgttccttaccttgtatgatctagtctgagaagttacatggcatcactttctctactttgttggtcaacccacctttgctgtgctgtgctgagtcgctcagtcatgtctgactctttgcaaccccctggactgtagcccaccaggcttctctgcccatggggattctccaggcaagaatactagagtgggttgctgtgccctcctccatgggatcttcccaatcctgggatcgaacccaggcaggcagattctttaccatatgagctacaggggaagcctaagaatactggagtgggtagcctattccttctccaggggatcttcctgacccaggaattgaaccggggtctcttgcattgcaggtggattctttaccagttgagctaccagggaagccctcaacccacctttatcgttggcctcaattcaaaggaaggtacatagatccacctgtcaattggagaagtgtcagagactttgcagacacgttttaaaaacaccctgctcgtttaacagatactgttagtaagcgccctcttgtgtcttagcagtcttaggtacatctcaatagatactcagtgtagtactatttttcttcttacctataggagataaagacccgaagtaagttgttctttaaagctttaagaaaggagtacaatatttcacttcttaaaaatatttccttacatggatttttttttgtctttttttttttttttttttagaatatagtatttaatgaaaaatccatgcttcagtggtgaaaatggcaggcttcctagataatttccgttggccggaatgtgagtgcatcgactggagtgagagaagaaatgcagtggcttctgtggttgcaggtatattggtaagtggaaaggcgtcgttggtgacatttatgcctcacctttccccctgaaaattgatcacgattcctttgcactatgaataaccaagataatacagtttttgtaggcagtagttttttccttccttttttgctttaatatttatttatttagtttctggccgtgctgggttttcgttgctgcgtgcaagccttctctagttgcagcacccgtgcttctcattgccatgacgtctctccttgaggagcacagactctagggcacatgggcttctgccgttgctgctcaggggctccagtgctcaggctcagtagttgtggtgcatgggcttagtgctcctctgcatgtgggatcctcacggaccagggattgaacctgtgatccttgcactggcaggcagattcttaactgctagatcaccagggaagtttttttttttttttttttaaacgctttttactaaatatatcaaacatacagacaaaaatagaatggtataaagagtcccttctcaccccctgtacttaatctttgagcttcaaaaaaattaaatcatggacttctctgatgggccagtggttaagactccacgattccactgcagggagtatgagctccatccctcctcaggggactaagatcccacatgccgcaatgaaagtgaaagtgaagttgctcagttgtgtccaacgctttgggaacccatggactgtagcctgccaggctcccctgtccatgggactctcccatttccttctccaggagatcttcccaacccagggatcgaaccttggtcttctgcattgcaggcggattctttaccctctgagccactagggaagccacagggcacagtgccaaccccccccaaaaaaaaaatcagatcgtggccaatcttgtgatggaaatcaagcattcccaggtcccactgaataagatacttgctgtattttacacgtcattccagagcttctttatgatactggcatactccatcatgaagttttgcattaattttcttggtctgaagactgttgttataaaacttttcattttgaagctaaatgtattctggtgcctccaaggcctggaatgagttacattccctttggggagctcatcattgaaaccacaaccaccttgagctgggaccagaaagatctgttacacttaatgtaaatttctctttttcagtgtataggtctacacctgaagtccaatagaaaaaaaaaataagtaggacaagaactaaagataactgtgaagcagtatgcatgcagaagtcttttaggtgtttctaagtttttcttgctctctagggtcatctctcctgcacttaatttgcctatgaattccttagtaacttttctactttgtctgttcagcctagtttacatagaaactttacattttccaaactcatatttaatcagtttacagtatttaatcaaattgcctattaattaaaatcatagcaagcttagatgttttcttggagacgtggcaactcatttgtggaaacgaaagtgtttggtcacattaaaaaggaatgtctgagtgctttttaatatgaataagagagtgaaaccaggtaatcagggaactggttagttaagagagctttggttgtgtataattttatggtgcatttatggtgtattttatggttgtatataaatttatggtgaaagaagcagataattcattcctagataataaatttttcatcttacactgagagcaggacatcagaatcttacaccgatttgattagttggatttatctcatcactataaagaataagggattcttattttttatatttcagcatctaaaactccaagtagacatatttcattgtatgtttcaattatatggcccatagaaaacgtgaaatgttaaggaacacgtaaaccaaagtgttagtgttagtgctgttttaacgacatgggctctttctccttcccaagttttttaccggttggtggataatgatcgatgcagctgtagtgtatccgaagccagagcagctgaaccatgcctttcacacatgtggtgtgttttccacattggctttcttcatgtaagtatgaggtaactctcaactcaagattatttttctaaaaacttttttttctcaaaagtttaatgctatctggaataacttcgattgagtctttaacatgatagatatatatgtgcgtatatctatattcccattttattaaaatttttaaaaatcaagaatgactgttgaatttggtcagataatctttttatcctctataatgattcagcatgtgattttcgatcttatatttgttaaactgacaaattactatgttttatagatcttaagactattttttgtattttaacatctctgaatatcagcatgcttctcatagtcattggtatcttataattcataatttttttccttggcagcatgaaaaataatggtgcatcttaaaaatcattggcattttagatttaatcaagtttgtacatttgtagatttttttaggaggggagtaatccttgaatattctcatatattcatcttttaccatggaatattatttaaatgtattattgactatatttgctagtatttgggggaggacaggattaacctttaaattaagagattgatctatggcttttctattaaatcattttcaggtttagccattctgtcacttcctaaaagtttagaagtttttcatggatgtcttttaataatttaaaaactaggttaaacataagattgtataattttattatagtcaggagctttaaaaacgtttaaatttgtagaagatggatctacttatattcattcaggatgctaagtaaagacaattcctgctacaaatgaacctgctctgacaaaagtggaaagagaagctgaataaagtgagcctatttattatacgtaaaccacatgttctctgaatttgagaaatggatgagagaaagacacttgacttttaacacaaagagaaacttttgagctcttggttatagtgagagccttaaaatggggtcacacacagcaggccactcatgtaaaatcggcaaggaaatcagaaaaccgaagtctctttcataatctctggaggcacgtgatagtaatccctgaaaattaaatcttttctgggtgtattttagtaaagtaagactactgtaatatttctatccattaggacatttaagttaaaagatacattcagttatttagatgttgactttagttagaaaatgtttctcttctaaatgacttgtgaaaaagatatacccttctaaatatctgtgactctcttagcagcctgaaagcttattggatgattttgtattgttctaggataaacgctgtgtccaatgctcaggtgagaggtgacagctatgagagcggctgtttgggaagaacaggtaaggcccttttgagtggttactgtatgctagtgaaagagggatttatcagtagaaaaaacaaagcctcttgtgagtctttatttagggatggtaatgattatgtagaatttttaatgttttgctttattaaaagtttaaaagtttttgttatttaaaactttaagaaagttaaagttactggtttttgacatgttatattgcccatagtatatagataaaatataccactcagaatcagtggatcttgactccaggttattcttcctatactaatgatggatttattcttatcccaaatattgaccaataatattacttacaatatagctgattgtgaatatctaacaccaaagtacgaacacattaagagatcaaacttagggctacagtgtttttcacatttagttctgatcacctgaataaccaacccatagactacaacaaaagtgtctagaacagtcatgctgtctacatacacatttttttgtttgaaatcttttgatttgtcatccaatagtatttttttttattccgactataacacattctattagaatccaggggtttgtttccagtggaattttcttgctgtatatgaacagtacaggactagacatcctgtttctagcctttaaggatgagggagggtaacttgtaattatagtcagaaattgggaatacgtgggaaaggaattttgaacgatgattaggaataatagcaaaaaaaaaaaaaaaaaaattaaaaaatatttaaaaaaaggaataatagcaagcacttgcagaattcagttgagttcagttgctcagtcatgtccatctctttgcgaccccatggactatagcacaccaggcttccctgtccaataccaactccaggagtttgctcaaactcatgtccatcaagtcggtgatgccatccaaccatctcatcctcatcctcctgcctttaatctcttaacatcaggatcttttccaaggagtcagttctttgcatcaggtggccaaagtattggagtttcagcttcagcatcagtccttccagtaaatattcaggacccatttcctttaggatggactggttggatcttcttgcagtccaagggactctcaagagtcttctccagtaccacagttcaaaagaatcaaatcttcagcactgctgatttctttatagtccaactctcacacccatacatgactactggaaaaacaatagctttgactagacggacttctgtggacaaaataatgtctctgctttttaatatgttgtctaggttggtcataacttttcttccaaggagtaagcgtcttttaatttcgtggctgcagtcaccatctgcaatgatttttcagcccaagaaaataaagtctgtcactgtttccactgtttccccatctatttgctgtgaagtgatgggaccagatgtcatgacctttgttttctgaatgttgagctttttttttttttgaaaatcttttgaactttaatggtaaagaaaatataatacattgaaacatttgcaatgtaaataaaacactgcttagaatgaatgttgagctttaagccaactttttcactctccactttgactttcatctagagtctctttagttcttcttcgctttctgccataagggtggtgtcatctgcatatctgaggttattgatatttttcctggcagtcttgattccagcttttgcttcatccagctggcattttacatgatgtactcttcatataagttaaacaagcagggtgacaatatacagccttgacatactcctttctcgatttgaaaccagtttgtttttccatgtccagttccaactgttgcttcctgacttgcgtacaaatttcacaggaggcaggtcaggtggtctggtattcccatctcttgaagaatttaccacagtttgttgtgatccacacagtcaaaggcttttggcgtagtcagtaaagcagaagtagatgtttttctagaactcttgctttctcaatgatccaatggatgttggcaatttgatctctggttcctctgccttttctaaagccagtttgacatctggaagttcatggttcacatactgttgaagcctggcttggagaattttgagcattactttgctagcatgtgagatgaatgcaattgtgcagtagtttgaacattctctggcattgcctttctttgggactggaatgaaaactgacctattccagtcctgtggccactgcagaattttcaaatttgctggcatattgagtgtagcactttcacagcatcatcttttaggatttgaaatagctcaactggaattccattacctccactagctttgtttgtagtgatgcttcctaaggcccacttgacttcacgttctaggatgtctggctctgggtgagtgatcacaccatcatggttatctaggtcatgaggtcatgaagatattttttgtatagttcttccatgtattcttgcctcctgttcttaatatcttctgcttctgttaggtccataccatttctgtcctttatcgagcccatctttgtatgaaatgttcccttggtatctctaattttcatgaagagagctctagtcttttccattctgttgttttcttctatttctttgcattgatcactgaggaaggctttcttatctctccttgctattctttgaaactctgcattcaaatgagtatatctttccttttctcctttgcctttcgtgtctcttcttttctcagctatttgtaaggcctcctcagacaaccattttgcctttttgcatttctttttcttggggatggtcttgatcactgcctcctgtacaatgtcaccaacctccatagttcttcaaacactctgtctatcagatctaaccccttgaatctatttgtcacttccattgtataattgtaagggatttgatttaggtctttcctaaatcgtctagttgttttcctcactttcttcaatttaagcctgaatttggcaataaggagttcatgatctgagccccagtcagcttctggtcttgtttttgctgattgcatagagcttctccatctttggttgcaaagaatatagtcagtctgatttctatattgaccatctggtgatgtccatgtgtagagtcttctcttgtgttgttggaagagggtgtttgctatgaccagtgcattctcttggtaaaactctattagcctttgccctgcttcgttttgtactccaaggccaaatttgcctgttactccaggtatctcttgacttcctacttttgcattccagtcccctgtgatgaaaaggacatttttggggggtgttagttctagaaggtcttgtaggtcttcatagaactgttcaatttcagcttcttcagctttactggttggggcatagacttggattactgtgatattgaatggtttgccttggaaacgaacagagatcattctgtcgattttgagattgcatccaagtactacatttctgactcttgttgactatgagggctactccatttcttctaagggatccttgcctacagtagtagatataaattcgcccattgcagtccattttagttcactgattcctaaaatgtcaatgttcactcttgccatctcctgtttggccacttccaatttaccttgactcatggacctaacattccatgttcctaagcaatattgttctttatagcattggactttacttccatcgccagtcccatctacaactgggtgttgtttttgctttggctccgtctcttcattctttctggagttatttctccattgatctccagtagcattttgggtacctaccgacctagggagttcatctttcagggtcatatctttttgctttttcatagtgttcatgggattctcaaggcatgaatactgaagtgatttgccattcccttcttgtagaatactttgtgtgtaccaaagactagcctgaattctctacatatattaactcagttaattttgcaatagtccttggagctaagcgatcttgtcctcaattttaggtgaaggaactaaggcatagagctcaagtaacttgtccaaagtcagaaagcaagtgtggtggggccaggatttacacactgacaggctggtttcagagcctacgcttttagccactgtgtcatgcttgtatccagtcgagaaccgtttagtctcctggtctgttaccattactcagtgtaattgaggataattttatatgaaatataaagttcagtttaaggtgtacaacttgaattttgacaaatgtacgcagtgtgtaactacacctgcagtcatagtgtagaatatttccattactccagaaagtttaaccccctttcccctacctggccaccactgatctgcctcctgtcaatgtagttttgccctttctagaatctcatgtacccactgaatgactcccactttccctcttcagcccctggcaaccactactgtactctctgtttctgtgagctcgactgtcttagatacctcacatgagggcatggggctggaagaaggaaatcctgccgtatgtgacaatagggatgaacctggaggacgtgatgctaagtgaactgagccagttacagggggacaaataagctttcttttacacctgatgctttaaatgctgatgcagattttataatttcacttgcattgtgatccttgaagaattggagaggctggagatagtgacaaatgacagacaaacctaagttaaaagtgcattgtggggcttccctggtggctctgtggtaaagcattcactgccagtgcaggggacacaggttcgatccctgacctgggagggtcccacacgccgtggagctcctgagcccgtgagctgcagctattgagccgctgctctagagccacgagccacaactactgaagcccatgcaccctagagcccgagctccgcagcaagagcagccaccacggtgagaagcccccacactgcaactagggagtagcccccactcgcaactaggaaaagcccacagagcaacaaagacccagcacaaccaaaaataaaaataaataaaaattattttaaaaagtgcattgtgtgtgtttgtgtgtacatgctcacttgcgtgtcttgtgccccagcttcggcaagtagtgtcagaaatgagtgagaatgaagaataaaagcatgtattagcaagtgaaaatgttgtgcatagagcgcacatttatttatttgatcattaaaaatatattccacagacattgctgtggattatgttactattatctattttgtatagaaaattgtgctgtaacttacccaaagctttttagcttaaaggtagaacttgtatttgtcttgggtctgtctggttccaaagcctgtactttttactcttagtgactattacattttattccatgattattctctactcagttaaagttcatagtacagtttatacatggtgcctttagtgcaagttctgtctagtacttcaaaaaataagggcagactgtcttataggcatgctcagttattgccacactttcatactattttaacagtttatttgtaatttattcctatttaattcccagagtaacttgcaggagagtgttatcaaagtaataaatatacaacaaatgggaatgttaaataagaaggaacaggaaccccaggtagaaaggagatcttgtacttagaatctaggacaagatggatactcttattaattgtttattaacctgactctgagcttccttgtagtcaaagcaaaaaagggaaaatattagttttttattttttgttaaacaaaagcatactcattttttaagggaagttttttttttcttgttctatcagaagagttttgagtggtcacatataaaggacatgaaggaaaataattacaaggagttttggtagttccttttcatttattttagaaaaaagctgtgattgaatttggaagatgtctttctccaaggagctaaacattactgtatatttctggagatctgcttagtgttatgataaaactgagataatctggagacccgtttttttcaaacatcagctattccagccatgctgagctttgagcttgctgcttatctggtgtccaaaatatatgaatttctgttcacttagtaacagaatatctgcaatgaaggcaagtttagctattatggaaatcaacttgggttttattttcattccagtggagctttattcaaacccttccacagggtgacaggctgtcaatatacctgtgatcagggtctggcacaaatgctaacttgctttccagtaagtgtgttgaatctactcacgtgtccagatgttcactgtattgagattctgtgttgtataaattcaaaaattctacatagtgaggggttgaagagatggttttgtccttgaacttttcaaggatacgtggcacaagttgccacctcatccataagagagactgatatatggctgctgttagtaccatatcgagtagtaacatgatattaatactgatgaagaggggacatatggtctttattcatttgcagtctctctttcctgtatggtaatggctgtctgaaatacatttgttacttctaatagaacaattactttgataatatataagaggataacttttcagttagggttcaattaatcagtttggttaagtaggcagacttatgaagcctgcctactttaatttactcagctgttagtttttttagccagtagaacggcaacttaccctttttcccttcccaagtattgctttaccctttttagttttatttttttaaatcttcattcagttaattattaaagcaggtgtatataaatatgtgactatctttgataggcatagtgtatattaagttgtgtgttctagtgttatgtattactgagacatagaactgcggaaatgagcaaatcatgaagcctgcttttcacacaggtgctcgagtttggctcttcattggtttcatgttgatgtttgggtcactgattgcttctatgtggattctctttggtgcctatgttacccagagtaagtatttattcctcttttctttcgtaggagagattcagatatgtcttttctatgtggcttaatctgttatcttctcatggagtaaaatttagtgtaattactcagcttcaagctaagactctgtgtaaaaataaaagttgtttaatgtaactttcttgtggggtcattgagtgcagtagggtaggctcgctgggaaatccaagccactgacaagaccaggcaactctcagccgtctctcgaggttctcattcctttcttaccctaagcagccaggctctgcactagaggccttttactgagggtcatggtcttaaagtgggaaccctgcacagggctacagccccttatacacaacttgaaaatccatgaagtgctgaaggtcaagaaattcataaccagcttggcagcaaaacctgacttaaattgacctggggctcattattatctttatttgctttaataagcattcaaatgttttattatgggagggaatatggttgtgtgattgtgggatactggtccaaacccagttgcaggtgctatgtaatatgccctgtgttatcattcttaaatctgaaaaattctgagttctaaaacatgtctggccccaaggatttcaagataaggtgttatggacaccagtatctttctgtccactgatacatctcctctccaaccccagtctctaatttttcattcataggtacaaggggagtcttttaagtgcaggattgaagacgtgtgtagcgttcatgtagaaactgttgatgcaatggagcaagctcttagtacactgttctgagtcttaggactgtttcagtcaccacagcttttcatcagggaggcgatgagaggttttgaaaagcaggacccagttgtaccctgtactcctggaagcatcggaagaacctttaactggctctcccccttcactccaaagataggatcagtttcagataacactttattcatcatctgatgcctctgtctttggaatctctttgtcactctgcttaactgtcacatctccttttcctgacccgcagctgaccttttaatgtagtgataggatcccttaagtatcataggttgatcagtattagattttggaataccttcatctctcattttgtgcaaaattaataggtgtaagaggtcagtggttgactaatgtttaaataataccactcaccaaatgtatctaaaatgtgttattttagttaattaaaaatactatggagcttgcagttgttggcctgttccatgtagcatgcgcaatcttccttcccccaccagtcgaagtgcaggatcctaaccactggaccgccagggaattccctttagtggttgtatcttaatctttaaagatccagtatatattgagacatttcttgattatggattttcatattccttttcatattcatattcattttcatattcctacagcactgcttattatatatacttaaagtgttttggccaaaccacacagcctgtaggatcttagttccctgaccagggactgaacccgcactccctgcagtggaagctcagagtcttaaccactggaccaccgaggaattccctatgtctacatgttagtttgcaaactgaacatgcatttacttcagagagcatttctaacacgtagttcacatcttttagtgtacaggtttcctggaactgttactgatagtagcagctgacagtcacacagtgcttcatgagcaagcactgtcatgagtgctgtgcgcagtctacacctctcacactctgtgcggtagctgtgcttaccatgtccattttacagatgaggaaagtaagggataatgggttaaataatttgcccataattatgcatttagtcagtggtagagttgggattcagatcccagggtacggctcaatcttggagcttttaaccatgtagctgtattgtttgctgtgatttcaaaggctacaaactgaatatttcttcatcctacctagtatttttaatcaacattgattgttttataaaagttaatatccacaaaaatttgaatcatttccaatgttttctttttccttcttagaaagagagtgactcttttctccaggagaatatgatgatgaattctaatgattctttttgcatatgtgtcagatttatgaaataaaactcttaaattcatgaaggaaaatgagctgaacagactgttagatcatcagaaatgtaatttgcctctttctaacattgcatattcctaacgttgtgtatttctatcactgtgtacttctaacattgtgtgtttctgacaattgtgtatttattggccatgggacgtgacggatgagctgctgcttcctcagcagttcagatgtagctgaaaccatagcaaatacttaagtcaaaaagaaaatctagtaaattctttgtcttttatccagaatgaaagtaatcttttgttttaagagaataagattggcattttcttacttcagttttgttgtagatttcttttttcttttctttttttggctgtaccatgtggcttgtgggatcttagttccatgaactgattgaaccctgaaattgagccccaagagcgaaagcacagagtcctcgccactggactgccaggggattccctcattgtggattgcttggagttaatgaataatagtagttattttataatatacagagcattataaatgtcacaaatactttgttgttgacctttgccttttgtaatcttatgatctgtttcactttgtatgtgcagatactgatgtttatccaggactagctgtgttttttcaaaatgcacttatattttttaggtaagttgcctaatttttaaactatacgtgtataccatttacagaaacatcatctttattataagagcagcatatgcaatgaaacatggataaatctacagtggataaaacttattttaaaacgtgaaagttctactattgcataaaagcatacataaaccacttaattaggggccctgctatatgccaagacctaagctggatgctttatgtatgttaactttttaaattcccgtgtaattgtcttaagtatgtgaaccagatggtgctcctattttatcaatgagaaaataagactcagaggcttacttaagttcacttaataagcaaatgcagaacagagatttggacccaccagactgctgtttccataggctgtgttttgttaagaagccatatcatgcaccttcagttaaaaaaaaaaaattagaattaatacataatatgcatgtcatatacaaaacctgattggggaattaaactttttttttaagtttttaaagataactttaagtaaaataataaaatgatccgaagtgctttttaggggtaatcttctataaagcttccaaaatgaagcctgtatcctttgctttttgagatgaaaatgtcttttagtgtaaagataggtaggtactttgggcatcatttataaaattacaccccttaccctactcctcactcactgaagcattaagatctaagtgttgaagaagtttgtttttgtcattggttttaaggagttggattatggagggctatggtgtcgttttcttcatatttcttctgtttggggttcactgagtttcttggatctgtggatttatagttttcaccatacttggaatcttttcagacagtatttcctcagatctttttttctgtccacccttccctcctgggttccagctatacacatagtaggctgctagatgttgttccacagctcactggtgcttcgttctttgcgtgcttttttcctacctctccaccaccgctcttctgcccaccaagtcttcttctcttgttttctctctgtgtttcatttgggttagtttccagtgttatatctttaaattcactgatgtctgcttccatcacatctaatctattactcccatccagtgtgcttttcatctcagatattgtatttttcatctctgttaacttgatttgggcatttatttttttcaccatttccacgtctctccctaacatgcttatgcttttcctctgtcttcttgaacatatgaagtatgtttataactatttcaatgtccttgtctaattgtatcaattctcagtctgtttctgttgattacttttgtttccttttttcattctgggtctgaagctctgtttgctctttgctggtagctgactgggagctggacttttgggtgttcctttaaatgtttttgagctttgttctgaatgcagctcagtcatttggaaacgagttgatcctttggatcttgcttttaagctttgttaggcaggcccagagcagctttagggcccccttgctaagccagagagcacttctcagtgttcttcctgatgccgcatgtgttctgaggtgttcactctgctatgagattgtgaggtattcccagccctttgggagctctgggaatggttctttccaatgtttccttcccttttcttgggtagtttccacacacgcatctactgtcagtactcggcagaagcccatgggaccctaccctctagctctctgtcctccaccttgcacactctggctgctcagcctcccggaactctcgacactgtctcgactctgctcacctcaggagacccctgtgcctgggctccctcttactgcaccgcggctggggcactcttggttgtgaaagacgtgtgactgtttctgcgtcttgtgactgtatttcttggcacatgactgacacccttttgggaatacattgaatttgcacaaagatgtcttaggcactgtttcgagatcaaatttaaattcagattcagccctttgcaggggcagatgagcctgtgtaaatgacagttggttgaacagaaaccttgtgtgtgtaaaggcctgtgctcacgtgggcagtggctgctgcaccagctgtgtgctccgcccagaggccagcaagttacgcagccagccgtgcttcccgtgtgccaggccttttctgagtgcagagggcagctcctcctcctcctctgtttgctgtgcctgctggtccgccacgccctggccactcacctttgaagtttcttaaggttctgctctaggcctcttctagactccttccctctctcgatgaggtcctttttgctggggacttcagttagtacctgtgtgccagggagccacagatgtctgtctctgtgtctaaaccatgtattggattcttacttatcccttcctgagtggctaatgtttcaaatctaacacagccagtgtacccagagctcaaactcctggtcccagagtgtcctatctttctggcctttgcttcttcccctcatgccttgctgaggtaattatttcttcctttcctctctctcctcctcccttccttcctcctctcctccctgcctccccccaggtcttcagggctgtggcagcttttctctagttgtggagagtgggggctgctcttgctggtggtgtgtgggcttctcactgcggtggccgcttctgttgcggggtgtgagctctaggtgcatgggctcagtagttgtggcgcataagcttagatgccccgtggcatatgggatcttcccaaactggggatcgaacccatgttgctgcattgccaggtggattcttaaccactggaccaccccggaagtcccacactccctttcttttagatctcagttcagtcatcacttccttaggaaaaccttgacctctaactaggtctgatccttgtatttctctctcttggtcccatgggtatcactgagttgggatttggttttctcccactggtgagcacatttgtctagttttggctcacagtcccattcccagtgcttagccaggtgcctcatgcccagccagcactctgtacagtaactttctgtaaatgaatgaagaattgcgtcatggtctgttttaggatgcttcagtttttgtagctcagatattgtagaaccctagagatgtgaatgaccttattgctggccacgatgagaaatgtgctctttcctttactggtgtcctatccagtaactttaggctttaagaagatactaaactcagccatgaggtccacagactgctttataaaacaagcaaattcagaccaacagcaccacagtctttaattttagaagctgatagaaaggatcagtgaggtacccatcaaagcatatttagaaaatgaattctctattgtgtttctatgtgattttacctcacaatttattttaatatctttccagcactctgatctacaaatttggaagaactgaagagctgtggacctgagaccacttctcaaatcacgttttccttttgttatattctatctgtagataattttttatttcagtatagtttacacattgccaaatggaatagattgtacattaaatgttttgtctctttacacttttatgtaaagccctgagtttttaaatagttttatgaaatttctgtcctttttttttttcattgaattagattgttaatatgtacatagtgtaagactatatagatgagatgaggagtgtcagtttttttattcttgaagacttaaagcttaatatgttccctgagccagggttgtatcatcatggtcattgtagcattaactactttgcctgattttcaaagatgtgcaaaaaatgcagttccacatatctgaaataagcactgagccattaaaaggggtattttagcaagttgtaatttattttggcttaaaaattagattttttttaaaggaaaaatgtttgttcttatgtataaaaaaagtggacttttatatgaagatttttaaaaatgcccgaaggactagtttgaaaatctgttctaaaaaacaattcctctactaagactttatttgagaaagggtaatacatggtcgcataagctcagttttacacggctgatgtaaaaagattggtaggcagctcagcaacatgcttcttaacaaaagcagcttaaaccgttgtcgtttgacaacctactattatctgatgttaccgaattctgtatcaagcaagtttgaagacaactgcagtttaaaagcatgaaccatataacaaaaagtggaataattagattcaggataaaagcactcttcccaaaggggatcctcatgacctagtgagaaattaggcatttcatccactcagtgacttgactgcaggtctgtctttgcttcagctctcaaaacatgaggtgaactctccctgccaaatacatctttaacctgaaagttcttactccagttgaaagcttcttttgctgagtatgaaatactgtatttgcactatgtgtattcccttgagagatttcaaagggagagctgggtctttatttctactttggctttcctttgttttttttgttgcacttttcaacaggttttttgttgttgttgcacttttttcctccagagggacttttctagagccttttgttgtaagacagaatagtattagtgatattatatgcagcttctaacataagccgtgttttgcttatgttaacgtctctcctctctgaggttttaccgcgcacagagtatgaagcagttgtggaatgctgtgcctttgtctgatatcatcttgtttaatcactttctctttgttgttttttccttcaaaaataccgtctggcttccaataaactgtaagactaattacatgtttccactcccttgtaacttgttgcaataaatattacttctcacacattgtaatattgttaaatctgttggagaaaacaaactctacagtttggcttgctgctcaggtttcagtcattcccagtggtcctggtcaaagaagtgacttccctttacaaaatctatatatatatatagattgcctgttgggctcaggggacacaaccgctcagcttgtgagattctagctccctggccagggctcaaacctgggccctcagcagtgaaaatggggagtcctgaccactggaccagcagtgaactcccaggagaaatatattcttctcagatttatgaggtgctactgtgaaggctcagacaaggcgatggcaccccactctagtgctcttgcctggaaaatcccatggacggaagagcctggtggactgcagtccatggggtcgcggagggtcagacacgactgagtgatttcactttcccttttcactttcatgcattggaaaaggaaatggcaacccactccagtgttcttgcctggagaatcccagggacgggggagcctcgtggggtcagacacgactgaagcgacttagcagcagtagcagcagcagtgtgaaggctaatgaagggaaggctgactgaaatagtggctgctttttctatttttgactctgtcatgaatttgttttttaattgggagcaaatcacttgatttccctgtttgtttcctcattaaaaaaaaaaagataatgttagtatccactcctatcagacactgtcagaatagactcctttgtaaacctttaaaggtacatgtgattcccttaaaatctccctgctaacacaggttcagtggctattgaatccaagtgtcttttggtgttttgtgtaggaccaacatcaccagagcattatatgttattaattacactgtttctgagtcctcgttgtatactttgggttgttgctgtagatgctgcgtctttccattatataaatttttgacgtgtatcaatgtaatgaggtagcagagattgcagactggaagatcagtgccttatagcatttgctgcttgtgcaagaaaccccagggtgtttgacatgtgtgttagtcactcagtcgtgtctgactctttgcgaccctatgggctatagcccgccagacttctctatctatagggttctccaggcaagagtactatcgtgggtagccattcccttcagaagatcttcccgacccagggatcgaaccttggtctcttgcattgcaggcagattctttaccatttgagctacagggaagtcctttttttttttttttttttagtgtttgacatagatgcattgaactcaggttcgctgtagttttccatgatgggagggttttcaaacataatgttaactctgaccgccccgccccgttttttttttttttttctattgctttttttttaagcaatttcattgctctgttttgtatttaattggctcatatcaaacatcaaatctctgccaaccttattgatttatccctttttttttttcttgtactctatcaccacacactcattttgattttgtttaaagtttataaaaatgacgggctactgttagacagtttcatctcaaataacaccctaataaatcctgagggataaacatctgatgctaattttatccctaacagtcacatttgattttaacagcctgtgctcttacttcagagcactctcttcactgtatcatctattcaaactgggaggattgaagtagaaattattattttagtccctttgttgattgtttttcttatttctttgaaaacaaaggagtagcctaacatgatggataggttgaatgcttttctgaaaaattactgaggaaaatcagaacatgctcatttaatcccagaacagttcttttttaaggaaattgtgatgccatctttgttttcacagtccacccccattttcctgtaaatagcctttattatggttgcattttatttaaaatgaactatatatccatcctggttctttcatacctaaagacagtgaacttttctgttcttcccctgctctcaatttcatttggaccaaacccaaaatatttctccacctcttctttttccttcccccatgctttaagctttcaagctttccaaatccagtcaattgtcttgctttaaaaataatttttatttacttaccttgggctgtgctgggtcttggctgctgtgcgggctttttctagttgcagccagcgagggcccctctctggttgcagtgtatgggctgctcattgcagagcaggggctcgaggcacgtggactcagtagctgcagctcccaggctctagagcacaggctcagtggttgtggcactggagctttgttgccctgtggcatgtggcatcttccccggtcagggatcaaagccgtgtctcctgcattggcaggcagattctttaccactgagccaccaggaaagccccagtcagttctcctttgctgtagaatctgtagagcctccccaagaccaaattagtgagttctgaatctttgctcctgatggaaatgctgggttaggtgagctttcggccacaacattttcctcagccatcaatacataaccttgcttcatgtgtgtttctacttaaaaacaccttgtttaaatgtagttgattcacagccttgagcgcaaagcaacactataccttacgcctgaaggaagcttctaactcacgcatttttttccctgctagcatttgtgaagaaccttctatgccctgtgtatggtctcatttcaccctcacaattggaggtaggaacttttattggagaggtgaagggacttgcccacggatcggagtcacggctcaggccctttgttcctgagtgcgaagtcctctcctcagccagcatttctgaactgccctagaaccttggcatttctttaggaaaagatgtacagtggtcaaagaagcttggaagacctttggttgaactaggttaaaattttttttttcctgtaaagttcctttcttagagctttttataaaatgtgtcctgtattttttaggaatgaactatcaattctatgggctgccctggtagcttagtggtaaagaatctgcctgccaatgcaggagactcaggttcaatccctgggtctggaagatcccctggagaagcaaatagcaacccactctgtattcttactggatagtcacatggacagggtagcctggcaggccacagtctcagttcagttcagttgctcagtggcgtccacctctttgcaactccatggactgcagcatgccaggcctccctgtccatcaccaactcccagagtttactcagactcatgtctgttgagtcagtgatgccatccaaccatctcatcctctgtcgtccccttctcctcccgccttcaatctttcccagcatcagggtcttttcaaatgagtcagttctttgcatcaagtggccacagtattggagtttcagcataagcatcagtctatggggtcccaaagagttggacacgactgagtgactgagtacgcacttccccagtagcatattggacaccttctgacctgagcggctcatcgtccagtgtcatatctttttgccttttcacactgcccatggggttctctggataagaatactagagtggtttggcattccatcctccagtggaccatgttttgtcattactctccactatgacccacctttttttttttttaatgtttattaacaccaaaaacattttgcattggggtatagctgattaacaatgttgttatagttttaggtgaacaatgaagggactcagatgtacatacacatgtatcccatgtcttgggtggccctgcacggcgtggctcttagcttcactgagttacgcaagccccttcaccacaaggccgtgatcaatggacggggtttagattgctttacttttccctaattctgccactgccacttactagctgtgtgagccccacgctgtttgagaattgatagaaggaaatgcctcgtggtgcctggaaacagtaaatgatcaataaagctgggtccttctttccctggtggctctgcctgaaggcgtttttcctttgtcatttgatggctttttagcctttggtcacaaggtggcgtgccatcttaagacagcaaacgagacacagatgtaaagaacagactgttggactctgtgggagaaggcgagggtgggatgatttgagagaatagcactgaaacatgtacattaccatatgtgaaatagatcaccagtccaggtttgatgcatgagacagggtgctcagggctggtaaactgggatgaccctgagggatgggatggggagggaggtgggaggagggttcaggatgggggacacatgtatacccgtggctgattcatgttaatgtatggcaaaaaccactacaatattgtaattagcctccaattaaaatttaaaaataaaaaatttataaagatacataatttaaagtcagaaaaaaaaagaatctggagacgtttgtttttttgagcctgccagtggttttttttctttctcttgtagtagatttaacacaggtttagtcattttatatagggttttagatgatagtatatgcctctccaattcttatatatatatatatatataggctgcactgggtcttggttgctgcctgcagagagcaggcgctaccgtctaattgccgtgaatggggtttttatggtggctttgctggttgacgagcacaggctctagggcgcgaggccttccgtcgttcctgcatgtgggttctgtagttgcggttcctgggctctagagtgcgggatcagtagttagttgccctgtggcatgtgggatccctggtccagggatcgaagctgtgtctcctgcattgccaggcagatccttaaccactgtccaaccatggaagccccctcttcaattgtttaagctgcagaaaataggatattttacatttctacaagagtagcaaggcaagccttctggaaccctgtggattatgccagtgcagagatcagcaaatctttgacatgggagcaccttatccaggtgacaagagggattcagtatgaggcaaagtgtatttacttctgttaacgaaagttaggagtgtagagattgactgacttattttgaaatagcttcagacttacaggaaagttgcaaaaataactcagagaattctagcttccccagatggtaacattttaccacaatcgctttagtctttttttttctgagacatttgacagtatgctgcagacaagatacctctttactcatgaacacttcggtgtatttctgcaaatcacaactgttctacaataccaaaatcaggaagttaccattgatagagcactaaggacttcatttgaattttgtcaagtgccgcactcgtatgctttatagtaaagaaaaataaggtttttttccggtccagaatccagtctgtgatcgcgcattgcatttagttgtcatggccctttagtggctcttttttaaaaaataattttatttatttacttttggccatactaggtcttcgttgctgcgcgggttttctctagttgcggagagcaagggctgctctctagttgcggcgcaccggcttctcatttcggtggcttctcatcgtggagcacagtgtctagagtaccggctcagtagctgtggcgcttgggcttagttgttccacggcatgtaggatcccagatcagggattgaatccatgtctaccgcatatgtaggcggattcgttaccatgagccaccagggaagcccccttttgctgtgctgtgcttagttgctcagtcatgtccaattctttgcgaccccgtgggcgggtccccatggcgaccccatagcctgccaggctcctctgtccatggggactctccaggcaagaatactggagtgggtcaccatttccttttccaggggatcttcccaacccagggatcaggtctccttcattgataaagaatcaggtcagattctttaccagctgagccacagggaagccccctttagtggctattaacttgggacaacttcagcctttgtcattcatgactaggtttttggtttttgttttttgcagtgtctagaccatggagatgaaatggtgacttcacctccatttacaatggcccagtattattttatcccatgtgtataactgctcatatcactgaaagactataatggctattattttgtaaaattatttattcactatttttggctgtgctaggtctttctctagttgctgcaagcaggggctactctctatttgcagtgcccggacttcttattgctgtgggttctcctgttgtgaagcaacggcgtgcgggcttcagtagttgagtgcatcagctgagttgcccccaggcatgtgggatcttcccagaccagggactgcacctgtgttccctgcagcattcttaaccactggaccaccagggaagtccatgacgaggtatttttgaagaatgcagaccaactgttgtgtagaatgcccctcaattttggtttgtctgatgttccgttgtgattaaattcaggttatgcagttttggcaggaataacatagatgttacattttcatgacatcaaagcaagcatacatctgtccccgtcctggtgcttttaactttgcttgcctgctcaaggtggagtctaccaggtatctctaccgtaaagaagctatttttctcctttataattttaaaagtactttgtgggaggggagactgattaagtcaaatagaacaaattcagtgtactttttactaacagcattgtgtagacttgaactaaagtgaccctgtgatatgtggaggagataaataatttgtgtataacaagttacaatctttatataagtggttcttgtctggttgaagaaaaacccaggtgcagcagggagagaggatttaacctcaccctgaaatctgcctgttttcagtctctaccatcctggtgtctcttgcgccagagcactgagctttcattttataaaaaattcctgatattatttcattataaaaaggaatattctccagaaaatgactggaaaacataagagtaaaaagaagaaattcacattactgtctaaagtctactaatgaaaaaaaaaaataaagtctactaatggcttttgggtgtgtaatatgttttaaatctgattttgcatgttagcatggaaactcactattaattttgacagtttttcaagaagaagttctaagtctcaaaggaaccaaatactttgtattctgtgtatatacagggcaccactggggtcgtgcagtgcacagtctatgcagatgtacacatggctaagactgttggtgctgtgttcatctttcacttgtagcgtggggctagccacttgagaagggtttgggtacccagagttacacacagtcatactgaggttcacagcaacacttcagaaaggagttagtcaagaagcacgtcaatttaattgatgaattaaattttacgctgggccctttacttgcctgttggcaaggactcagagtcctatctgggctcatcagctcttggaggtcctaggttttcgctcttgctctcaactacaaacaggacacttatcctcagggatatgaaatcaaatagttctattcacctgaatgcaaaaatgaagtaagcctaatttatgtgtgtgtgtgtgcttagttgctcagttgtgtccaactctttgcaaccccatgggctgtagcccaccaggctcttctgtacatggggattctccaggcaagaatcctggagtgggttgccatgccctcctccaggggatcttcccaacccagggattgaactcagatctccagcattgcaggcagattctttaccatctgagccaccagggaagcagtctaattcatgttcattataaattattaattcacatcactaattaattaaagtgtaatataattactttaattgattatattaatttcactagttaatatattttgcaagtgattatgttttctatttttttaaacaccaaaaacattttgtattggggtgtagctgattgacaatgttgtgaacagtgaagggattgcatcatacatatgcatgtatccattctcccccaaaccaccctcccatccaggctggcacataagattgagcagagttccatgtgctatataatagatccttgttggttgtccattttaaatatagcagtgtgtacataaccttcccaaagtctttaactatcccttatccccctggtaaccatgagtttgttttccatgagtctctttctgtttcttaagtaaattcatttgtatcatttctttgtagattccacatataaaggatgtcatattacatttctctctccctgacttaacttcactcaatatgagactctctagatcaatctatgttgctgcaaatggccttatttcattctttttaacagctgagtaatattccactgggcaagaatcccttagaagaaatggagtagccatcatagtcaacaaaagagtcagaaatgcagtacttggatgcaatctcaaaatcgacagaatgatctctgttcgtttccaaggcaaaccattcaatatcacagtaatccaagtctatgccccaaccagtaaagctgaagaagctgaaattgaacagttctatgaagacctacaagaccttctagaactaacaccccccaaaaatgtccttttcatcacaggggactggaatgcaaaagtaggaagtcaagagatacctggagtaacaggcaaatttggccttggagtacaaaacgaagcagggcaaaggctaacagtttttccaggagaacacactggtcatagcaaacaccctcttccaacaacacaagaaaagactccacacattgtcatcaccagatggtcaataccaaaatcagattgatcatattctttgcaaccaaagaaggagaagctctatacagtcagcaaaaacaagaccagaagctaactgtggctcagatcatgaactccttattgccaaattcagatttaaattgaagtagggaaaaccactagactgttcaggtatgacctaaatcaaatcccttatgatttacacagtagaagtgacaaatagattcagggattagatctgatagactgcctgaagaactatgggtggaggttcataacactgtacaggaggcagtgatcaaaatcatccccaagaaaaagaaatacaaaaaggcaaaatggttctctgaagaggcctttcaaatagctgagaagagaagtgaaaggcaaagaagaaaaggaaagatctatccataggaatgcagagttccagagaatagcaaggagacataagaaagtcttaagtgaacagtgcaaagaaatagaggaaaacaacagaatgggaaagactagagatcacttcaagaaaattagagataccaagggaacatttcatgcaaagatgggcttgataaagaatagaaatggtatggacctaacagaggcagaagataataagaagaggtggcaagaatacacagaagaactatacaaaaaaggtcttaatgatggtgtgctcattcacatacagccagacatcctggaatatgaagtcaaatgggccttcagaagcatcactacaaagttagtggaggtgatggatttccaattgagctatttcaaatcctaaaggatggtgctgtgaaagtgctgcactcaatatgccagcaaagttggaaaacgccgcagtggccacaggactggaaaaggtcagttttcattccaatcccaaagaaaggcaatgccaaaaaaaaaatccaaactactgcacaattgcactcatctcacacactagcaaactaatgctcaaaattctccaagccaggcttcaacagtacatgaaccatgaacttccagatgttcaagctggctttagaaaaggcagaggaaccagagatcaaattgccaacatccgctggatcatcgaaaaagtaagagagttcccgaaaaacatctatttctgctttattgactacgccaaaagcgtttgactgtgtggatcacaacaaactgtggaaaattctgaaagagataggaataccagaccacctgacctgcctcctgagaaatctgtatgcaggtcaagaagcaacacttagaactggacatggaaaaacagactggttccaaacagaaaggagtatgtcaaagctgcatattgcttaactgcttattaaacaatgcttatttaacttatattcagagtacatcacatgaaatgccagctggatgaagcaaaagctggaatcaagattgccaagaaaaatatcaagatatgcagatgacaccacccttatggcagaaagcggagaactaaagagcctcttgatgaaaatgaaagaggagagtgaaaaagttggcttaaaactcaacattcagaaaactaagatcatagcatccagtcccatcacttcatggcaaatagatggggaaacaatgggaacagtgagatactgtattttggggggctccaaaatcactgcagatgatgactgcagccatgaaattaaaagacatttgctccttggaagaaaagctatgaccaacctagacagcatattaaaaagcagagactactttgctcacaaaggtccgtctagtcaaagctatggtttttccagtagtcatgtatgggtgtgagagttggactataaagaaagctgagcaccaaagattcgatgctcaagtgtggtgttggagaagactccttagagtcccttggactgcaaggagacccaaccagtccatcctaaaggaaatcagtcctgaatattcattggaaggaccgatgctgaagctgaaactccaatactttggccacctgatgagaagaactgactgattggaaaagaccctgatactgggaaagactgaaggcaggaggagaaggggacaacagaggatgagatggttggatggcatcactgactcaatggacatgagtttgagtaaactccgggagttggtgatggacagggagacctggcgtgttacagtccatggggtctcagagagttggatacgaatgagcgactgaactgaactgaatattccactgtgtgtgtgtgtgtatatatatatatatatacataccacatcttctttatccattcctctgtcagtgggcatttaggtttcaactagatatatctttgtaaagaaaccctgggggtctacctcacccccttttttttaataaatgggggagggcccagagaagcccctcctgcctgtattctgttagcaggatgagattttgggcagcatccttctcagtcttcctagagcgcctgtgagcagcaccgaccagctccctccactggttgggtgctgccccaggtatcctcctggacctgtgggtcggcgccctcctgatgcagctggccatcctcagtcaccagagactggaagcaaggagggtgaggtgatttccaccatgttcccatcagagggctatagcttcttcggagggcctgtgggcacaccgaggagccggaggcctgactgctccacgggaagatgcctgtgtggattcgcactgtcaccaaacagtagggatggtttaggaggttcttgcctaaaacacaggcttctggcataaaacacctttattctggagagccttggagccccttggggatacacagttgttttccggtagccgaaagcagtgtaacttagtggctatgcagacttttaaacatcctatggactgagataaatgatggtgaatgaaatagaagtcaacaaaggcagacgccccgagcacaggctaggacctgagccgttctccacattggcagtttctgagtgagagggcagctgtggtttttgcagtgagtgaacgaacatcagcaggtgacctatgggtgcggacaaagtctcccttctctgcccgtccctcatccccacatcccacctggggttctcccctctgcaccctcatgtccatcagctcctcatcctgctggccttggtaccacccagagcaaaaggggctgcttcctctcccatggccctgaggtgtaccccacccctcaccccccaaccccccctcacctccccaacccccccccacatccccctaccccccaaccccgtctgcaatctgcatgctgagcactgcgggacccccaggggcgctattcacaatgaaggcccagaacatcctatgtttacttaaaactccgcacaaaacaaaggatcttaaaggacagggtctttatctaatgcacatagcagtcatgtatgagttagcagtggccttgatccaactctcccatcatctctgggtgacctagcattgatctagggcctatgtttctccattgatttgcctacacctaaatgacctccagcctttcctagtacatattccataatgtactttatagaatacaggcaagcatcaaatacccctcctcccatgtaatatatgacctttgaattaaacagtctcagcattaaatggggtggggtcttgtagggaccttctgtaactgtataaacctaaataatgggagtaagtctgttttctcctatacaacatacacttcattgtacagatcagagttcatcagactctttctgtaagggttcaggtggtgactattttaggcttcgcaggaaaacaagctcttgcaatgattcagttccaccttgcagcacaaaagcagccacaggctatacataaattgaatgagcgtcactgggtctcaataacagtttacttattggcttgcctggtggcgcagctggtaaagaatctgcctgccatgtggaagacctgggttgggaagatcccctggagaagagaaaggctacccactccagtattctggcctggagaattccacggactgtatagtccacagggttgcacgcagagtctgacacaactgagcgacgtgcactttcagtttcactatggacaagcgtgcatgcatgctcagttgctcagttgtgtctgaccctttgtgaccccatggactgtagtccattaggctcctctgtccatgggattctcccggcaagaatactggagtgggttgccatgccattctccaggggatcttcccgacccagggatcgaaccccgggtctcctgcactgcaggcagattctttactgtctgagctgccggagaaggagtgtcttaaataatttctgtcctctccttctgcataacaggccagccccacgcttactgaggaaggatggggaggccccgagaggccctcagtgaacccagttggaacccagtgtagcccctcccctacatgagcctggcccctgagaggcacctggtcagagtgccggccctgcacttgaactctgtcacttgctgaagctgccgccttcaactaagaagggactttccgggcctgaaccccacccagtctgccccaggacactggactgtctctgccctgaatccagtacagcctcatcagaatctggtccccataaccagcctgcctgcccctgatcagctggcacctccttttatggagggtggcacagagcgcttattcctaacagcgtatctgtcccccttcctgctggactcacttttagctggttttcttcctgctgtacacacatcctccccacctcaaccagctgcatcgtatggcccagcagaggaagcgctcaaatcctcaatttcctaaatggtttgagggtggtctttacaattgccctctactaactccgggagttggtgatggacagggaagcctggtgtgctacagtccatgtcgcagagttgggcacgatggagcaactgaatgacaactctttttccaaccctgtcccaactcaaggtgaacctgattgataacatagacatctcataaggggactcctctggggtgggtgggtggggggcagctgtgggtgggtgtcctttcctctcttgtcaccctggatggcaggggtcacgactggttagaaagtcagcccaagggccaattcctcaccagaggtacagggcccacctgagacagcaggtggttccatcaaccagtcctaggtacttcatggacctaccatcagcatttctacttcccattgtcaaggtgaggctgcccgtgggggcttctttctgaagcagaacttatggcaacatgtcactttctatgtgtgttggaggggagccgtgaagcgacgcatccatttcctaagcctcaggaatcagataaatggatttttagcccatcaatacttgccccatgagaagaccagcagcccagcggatacactgttggccacaagctcgttccctttacacgccttgctcgacgtatgcgacacatcacatttgaatgcagtgctgatgcagcttctgcaaaccccctgcctaacttttcaagcagtccagtgacacaagtcagaagttcttgctgcgtggcctctgggtgagtctgctgggcatcatagatagcgtcatagcaaaaagctgaaactttgcagaaaagaggctaaaataaagaaggtggagaggaaaccttcacacagactttcaaatgtctattgatttctttacagtttttggccacactgtgcagcaatgtggggtcttagttccctgaccaggggtcaaacccgccatctccagcaccggaagcatgaagtcttagccactgggtcaccagacatgtccctacacaggctgataaaaagttagtgaaacagtcttttatttctagtttggaaaaaaaaaaaagtcccttaaattactagaagattattcacgggattaattacattttaagccaggagatgggtgtcaagggccactgagtgtcctttgacaggagaggctgggacaggttccgtgacctgcccaaagggccctaggccttgccagaaccaaggaaaggaccccgtctcctgaccacccaggccaggcaacaatgtccgaaatatcacaagggtgtcacagcctgtttgctaacaaatgattacatgcctttttagtgtttaagcaaaaactttttttttttggtatgcagaatcagtctagaaacttgcaggatttaggtcttgtggctcagctggtaaagaatctgcatgcaatgcaggagatcctggttccatccctgggtttggaagatcccctggagaagggaaaggctacccactccaggactctggcctggagaattccatggactatacagtccctggggtcgcaaagtcggacacgactgaacgactttcactagttaaaaaaaatgtttgtctctcccacaactgacttcttcccaggcacccccaaggtctttttgtgatgagactaaggatcaagtggctccatccagtcctgacaggcatgtcgcagcttccttggcacagagaactccttccgtgggctggtggcttggaccagcactttggttcaaagtgctttggggactcccttcttgctcattctctggaaacgtcacgaccgacacagagtcccaagtgtcatcctttggcgagctgtccttgtccagggcatctaagatgggctgagccggatcctttaaatacttgaaaaattgaaaaccatcaccataattagtctgtaagttccagatataagaccttttgactttagtttgagttggcataatcctatatcattttggtgtaacttccacttctgtccaccaatgaaacagcttcaaaaatcctgaaaacccctccccacccctcatctcaatagcttgcacacgaatccaagggccaaccaaggggatactctgaaagtgtgtaaggtgtgtaactcgagaaatgaagttctgacttgctgcactggctggatgagggcttgtgggctattcacctggaatgtctcggaattctaacttttcaggaaaggaggaaatgaagcctcctggtcacctacaaggtaagggtgaagagggaaagttcacgggcatttttttctcagctaccccacccactaggtgtttctgctttatataacacacacatgggtgcggaggatctgcagcgggcagccatgggcgaatgagaaagtgcaggtccttgattcgaaatgctgatccacacccttaatgtgctgtgtctctcctgcctctgctttgggcttagacatcaattaccaagttacaaagggctttccaggtggctcagtggtaaagaatctgcctgccaaagcaggagacgcaggttcgatccctgggtcaggaagattccctgcaggagggcatggcatcccattccagtattcttgcctgagaaatcccatggacagaggagcccagcgggctacaatccatgggggtcgcagggaagtcagacatgaatgagcgactgaacaatgacgaccaccacaaccaagttaccaagaaccaaccgcatggctcttggaaatgctgaaagatactgaaatgcagtcagcttagcgctggctggtgagcagaggagcagcagcatgtcacgtgcacttgcgaaacctcaaaaatacaagtgaaacatgagtcattttctcatgaaacttcagtgacctttgatacagacttttcacactttcccaggaaagcaaatcgaaaggctctgtgttttaggttcaagccccaaagaaacaagtagcagtaaactcacttactggggcccggctgctagttctactgagagacagagttttttgggtttttttggttttgttttttagtgttttggcttcatcacatggcatgcaggatcttagttccctgatcaggcactgaacctgcgctccctgcaatggaagtgcagagtcttaaccactggaccaccaggggagtcccgagacggagattattaatgcaagtaaaactccgaggtgacagctgttctgttgtgacagtattaaccaggaaaatcggttgctgttgttgttgccgttattgtaattttgtggtaagaacacctaacttgagttctactctcttaacacattttgaagtgcatgtgcgtgctcagtcactcagtcatgtccaacactttgcaaccccatgggctgtagcctgccacgctcctctgttcgtgggatttcccaggcaagaatactggagtgggttgccattcccttctccgggggatcttcccaacccagggattgaacccaagtctcctgtgcctccagcattagtaggtggaatcttaaccacctgggaagcccctttaagggcacaacacagtactaattatagcacaatcttgcacagcagaaaccagaacttattcatcttgcataactgaaacttcctaccatttgaaagcaacgccccactcccctctcccctcacccctgttaaccactgtgttactctctgcttttctatgagtttgactgttattctacttagagtcttcatagaagcagaatcctacagcatctgtatgcaggtcccagtagggagttcaatgtgtatttctcataatgtctgtgtcccttaaacagctcatgacatatgaaggaaatcaagtgactacagctctttctagactttgtctttatagacgagatacaacaacatgagattctgtttctagtacttttattctgattttactgaagaatgataaacctccagaggcaaacagttttaagtattcttctatcagctagcttgtgatcccaagaatgtcccaatggctctgtcctcagaggacctggctgcctcactgagccttggggaggggggctgcggtgtggctgggcaggaaaacaagactatctgtaagacccgctggactatgaagaaggctgagcaccaaagagttgatgctttcaaagtggagtgttggataaaacttttaagaatcccttggacagcaaggagatcaaaccagtcaatcctaaaggaaatcaaccctgaatatacattggaagttggaaggactggtgctgaagctgaagctccaatactttgaccacctgatgcaaacagtcaacttgttgcaaaagaccctgatgctgggaaagactgagggtaagaggataagctggttggatggcatcacagactcaatggaatgagtttgagcaaactctgggagatggtgaaggacagggaagcctggtgtgctgtggttcacggggccgcaaagggttggacgtgactaagcaactgaacaacaaggcccacccattccacttttctttcttaaattctttaaagtaacatggcctgtgcgctaggcatgcaaggctttgagctcatggctctgggtgtgtttcctctagaatcctcctgtgtgcacactgtctaacccaaagctcatgctcttgactgcagcctccactggtccgtgagctccagccaggctccctgggggcagtctccaaacgcctgggattgatgtgttgtctccagtgggacctaccacggccaatctcctggatgggccagactaggccatcttttggccaacctcgtgccattaaaaaaaaaaaaaaactttttttaattgtggaaaagtacatataacacaggggcttcctttgtggctcagtttaaagaatccacctgccaatgcaggagacacgccctggaggaggaaatggcaaccctctccagtattcttgcctggagaatcccatggacagaggagtctggcgggctacagtccatggggttgcaaatagttggacacgattgagcgactaaagaacaacaacaaacacataacataaaatttaccgtcctgaccctttttaagcgtgcagttcagtggtgtgaagtctatttagattgttgggcaaccatgagcaccatctgtctctagaacttttttcatttttttcatagtaaaattgaaactgtccccgttaaacacgaactccccatttcctccctcccttcaggcctgggcaacctctatcctacattctggttctgtgaatgtgagtactcttaagtgctcgagtatgtgcaatcatgtagtatttgtcattttgtaactagttgatttccctgatcgtaatgtcctcaaggtcctctatcgtagcatgtctcagaactcccttcttttttttaaggttaacattccgttcatatgtatataccatatctttttggtgggggcgggggtggtgaatcacgaggcttgcaggaatcttagttccctgaccagggattgaaccccagggccatggcagtgaaagtgccacgtcccagccactggactgccagggaattcacaccacatcttatttatccattcatctgtcaatagacattcagggtgtttctgcctttcggctatggtgagtaatgctgctgtgaagacgagtgtacaagtaaccaagcaccacttttaactctgatctctgtgtctgtggctttgtccactgtcctactcttaggttttactagggggcaagaaagcctgacaagtcacccctgtgggcgtgtacatacctcctctatctgtgatggaatgcttggcggagagtggaaccagtgtttaaccaggcctctgtatctcagaaccaggaagagacaggaccctaccaccactgacagcaccaaaaaggtggttccggcagccaggaagtcttgttgaagcttgacagaagctagagagacaaccgaaaaacgaacaagatgacccacacatcaggtaatttctcatccaccactgcataaatacacttgacgtcccaggaaaatgaatggatactgctctcttccaccctgccctgtatgctttattgaactcttgagagtcccttggactgcaaggagatcaaaccagtccatcccaagggaaatcagtcctgaatattcactggaaggactgatactaaggctgaagctccaatattttggccacctgatatgaagagctgactcactggaaaagaccctgatgctgggaaagattgagggcaggagaagggggaaacagaggatgagatggctggatggcatcactgactcaatggacatgagtgtgagaaaactctgggagatagtgaaggacagggaagcctggcgtgctgcagtccatggggttgcaaagagccggacacgactgagtgactgaacaacaaaggcaatcctaaaacaaagcaggtgttacccgtctggcagttcttgttctggagattccagcacagcctcgttgtatctactgtgaattgctgtcttagcccgtcctctctggatctccctacactcatcaccacccttcaccaaaaaagcaattcctgattgcactattttaggagtgttctgtttccagctcagaaagaaagcacttaggaaagcatacattaccatctgctgccgtttcacagcaagatatgttgcttaaatgtccaggtcgagagatgttttctttggtcaaaaacagttctgccttgacttgaaaacagtatactcttaagggttttaaatcattcaatgtgatgaagttactcctgaacgggcgtgtcacctgcgtagcaagcatcaacaaccgcacacgtaaattacccgcacagggatggtcaaggccttccgtcttctccagtgtttccccaaattcacatcgaacacaataaccaaagaataaggcaattctggttttaaagagacagaataccaattttatacatataacgcttacagccgacaaatttcacgtgtggaaacgggaggagtgttgagaaacatgctgacggcattagagctgtgtttctggctgtgagatctgaagccccattgcagcaatggagggtccagagctggaatttagcaaatcccaatttccaggacgaaattttctcctttgaaatgaacattgtatatttcatggttagtctcgtctacagtttcaagtcagtggatgaacagaggggaaaagggcattctaggaaatactgttccttgggttccgaatctgcttctggttttcgcttcactgtgctgcttccctttatagttctggtgaacacggtcttagaaatttatgtcatcaaggaagagttgggtcccagattcttagaggatcttgtcccctgtctccctcgcctgccgtgacacctccctccggtttgtcacctccacatgttcggtcaacggcccctctctcattccgggcaaactgtcactattctatggggaaatgagaaaaagacaccacacactatggggatacgggatttctcctaaaggactgctttcatattgggagatacagtagaaaacactagggcttccctggtggtgctagtgataaggaacgcaggagacacaggttcgatccctgggtcgggaagatcccctggagaaggaaatggcaacccactctggtattctggcccgggaaatcccatagacagaggagcctgccaggctacagtccatgtggtcacaaagagtcggacatgactgagcacgcatgcgcacacacacacacacacacacacacacacacacagaatacgctacaaccactggaaatggtggcagcttcagagtgtggagataaagtggcttattatatatgttgactgaaaaaaaaggcagatcattcaacagtatataggacatgatcttacttttaaaaatacaaacggtcatactatatttgaacagtaggattatagatgattcaaaactttctcccctcctgtttaacgatgatgactgccagggcagaaaagaaacaatttttactccacataaggagtaaaatatgacaccacataaggcaatttcagggaattctgtggtagtccagtggtttaggacttggcgctttcactctcatggcctgggttcaatccatggtcaaggaactaagttcctgcaagctgtctggcacagccaaaatttttttttaagtaagaaataattattttaaaaaaggtaaatttaaggacaatatgcttttcttaaaaaaattatctatttatttggctgtgttgggtctcagccgcagcacgtgggatctttccttgtggcacacaggcttagttgcccttcagtatgtgggatcttagttccctgacctgggatcgagctcaggttccctgccttggaaggcagattcttaggcactggaccgccaggggagtcccaacactattcttttttgagtttatttcagcagccagttggctattccagaagaatcacagactacagagaagagctaccgttcaggcctgagacagtaaggaacgcaggagacctgtccttagaaaggtcttgtttgcaaggctgacccaaggctggcatctgggaacttggctttgaggagtgtcccacagatccctaagtgataaggctgttttaatgtatacatgatgcttctgatgctgaacacctgctctacctctgggagtcaggagccctggtggctctgctgggtcgagggtgcctgtgtgaccagcccccagtacgagccctgggtactgagtctcccaggagcttctctgggagatgcgatttcacatactcggttactcttgttgtcgggggaattgagagtagcctgtgtgatgaggggaagactcctggaagcttctgcctggactccttcagactctgccccctgtgtctcttccctttgctgactctgttctgtgtcttttctctgtaataagtcacagccttaagtacaactggacgctgagtccccgaggatccttggagcaaatctaggggttgggtttcgggacccttgacatttggactcacagctggaatggagactatatcagtggctttcagagtcactttagccgcagaatcttttgctcacagaagtccaaagcatagatgctctggttgaaaggggaatccctcccagattcttccagacctcctctgttccagttgaccagaactgtgaactcagattttgggaaacgattatttctttcttccctatttgctgagagtctgcccttcagtgagttttgccttccttggtgtttttacactcactgtaaagaaacaggggcttccctcgcggttcagctggtaatgaatctgcctgcagtgcagaagacctgggttcgacccctgggttgggaagatcccctggagaagggaaaggctacccactccagtattctggcctggagaattccatggactgtgtagtccatggggttgcaaagagctggacacactgagcgactttcactttcataaagaaacagagcaagtgcaaacatcagcaacgtgggagacacagcactgagagcacgggccctctggagccaggcgcctcctccgcgtgcctcgggcagtccttacactccctctccctctcagtgaaactgatgggtgcaaagggtaaacgaaaggatgtatccaaagtgcccggcccagtgccagacacgaagaaagctccagataaacatacagctcttaaaattcttataaaaattagagtaatgttgaacgtaggaaatcaggaggttcacacacatagtgaaacatcattcaatgtagcttgaagggacctccctggcagtctagcggttatgactctgggcttccacggcaggcggcacaggttcgatccctggctggggaactaaggctcaccccccacccccactgctgtcatacagtgtggccaaaaaataggaaaaaaaatgcagcttggatgatcagacactggagatgaccctggcccagacaccaggcccctttgctctgacccctcctttgtcaaccttaccctgcccaaggccctcacatggccccatttctcttttttttaattaattaatttatttttattttggctgtgctgggtctttgttgcggtgcatgggcttggttgccctgcgacatgtgggaatcttagctccccaaccagggattgaacccgtgtcctctgcattggaaggtgaattcgtaaccactggactaccaggggagtcccaggcccgaatttctgatggatccgggcatgtgcggttcccggatgtgcccagccttctccaacctactggcccttctccttggaacatgccctcttctcgccttcactgagacttttcacctattcgcattgccttctttgaaaaccattcagatcagagatgtcacatagcttaaccttgcagactgcaggagtaaaaataggcccatgagtagaaacaggcccatgagaccttcccactgctggagtgtggcaaagacttcctgggcaccagctgaatccagactcagaccacggggactgtgtgataggaggcagagagggccctgcagatgggtcttgtcctctaagggtgcactgggataccctggtgtccttggccacttgattttccttttggctgagcagagcagcttgtaggatcttagttccctgaccatgggttgaacccaccaactgcaatgggagctcagagtctcaagcactggactgccagggaaaccccctccttggcctttcgtttgctacccagaaactccaaagaaaagaacatcaaaaacagagaagaacatgctcttgcctgtttagctcctgccttctcccagtagtagacacaatacacaaaataggcctcggtggcagggacatcgaagggagcagaaagcctgatgataagggagccttcttctggggtcacccggatgttttctggaggcccaatggtagctgaaatagaattacaaacgagatccatcagtctatgtagatacacgtgtgtgcatgtatgtgtgtgtatatatatactgtgcagtgccgagttgctttagtcgtgtctgactctttgcgccacaagggactgtaggactgtagcccaccaggctcctctgtccatgggactctccaggcaagactactgcagtgcgttgctatttcctcctccaggggatcttcccaaccagggaacgaacctgtgtctcttgtgtctcctgcattggcaggccgattctttaccagaggtctttctgccgtatgctatgctaataacatgttttataggctagcttttatcaggtttccagagagctggaaggttaaccaaaggtcaaattttcatgaaaagattttgttagctcttaccttctatatatattttctttttgttacatatttttttatatagataaaagtggtgtttgcaaacttaaacacatttctcttttagctttttccaataggacacacttaaagataataacatgaaacactgctatcacaagggcttccccagtggctcaggggtaaagagcctgcctgcaatgcaggagacttgcaggagatgtgggttcaatccgtgggtcaggaagatcccctggagaaagaagtggcaacccactccagcctgtaaaaacccacagacagaggagcccggcaggctatcgtccaggggattgaggactgagcgactgaacaacaacactatcatgtatctatttgttaagacttttcatgttctggaatacatatcaccggagagtactgtgattctggaacactatagaagaaagactatagcctttattaagtaagcatctaacctgtataattaaccggaggaactcagatcaaggaacaggtcatgtgctccaagttcttaggggcctgtttctgcacgtttgacacacgcacgcagacgatcatatcgctgggaaccgtcacctgttcacgagaggagggctggctttctctctagcttccacgccccaccctgggctctcccaggttggggagggttaggcacgtggtctggccacctttctctctgcgtaaagtaactggtccccggagggcctgcactcttgccctctcacctcctttgttatggtggaggaactaagtccagacagatacactgtcgggtggggcccgtctcaagcctcagtgttgttagcagactggccacgaggaacagaaaaagcttgcatcacacccactcacggacgctggcacgcatatcttcaaggtgcccttcagacggtgaagtcgccagagcgccggtcagcccacccatgtgcagggccagggccccctccccgctgagcagattctccacacttttttgtgactcacccaagggagtgggtgtatgtgcctggatgaccacatcccttcaccactgaaaggtcagcgcccaggagtctgatcccaatgtgatgagcctgcctctccagggcggacagcctgccttctctccaggcccagaaggaggacctgataggtctgtgcggtgactaccgacagcggcgcccacggcctgagcgatcacttgaaacctggcaacacggattttacatgtgtgtccgcacagatctgcatgtaacaaccatgcaaggccatccccatttctcagagggggcaactgaagcccagagggatatgacctgcccagagtaacagccggtcaggggcagcgttgaggtttgaacccaggtttacgtgatgctaaagcctgcccccttcagccactgtcccaacccctctcccctcgagcccttggtaaggcatcgtcacgctgtttacccatcctgactcgaccacaagtgccgaaagcagcaatgggctctgcaaacaccactggctcgaagagacactctgccagtaacttaaccaatgacacagccagccgtttccggccgggaagacagacagcagcagctggctgccaggggcctggtgacatcacgatgggccctgcttctgtcgctgcctactctgttccctactaatcccactgaggtacagctcagatgtctggcagtgctccattcaaggacagaggcctggtccccagtagatgaccagctggcagggaccaccctgccttctcatcccatcctcaaactgctagcaaatactgatttttttccccccttagcttcttattacaggaaatttcaaacacatagcaagtagagaagactgtagccaaagagcatgtactagtcaccccattgtacatcaaccgtcttggtccaggaagttttgtttctccttcaccttgtaaggaccaccttgaccctcccactctccggatggtttggaacaaatctcagacattacatcgctgcatctataagatatgtatcttgaaaagaccagacccctccctttaaaaaataaacaaaataccattataacatctacagtatgtgaacaacaattgcttagcaagtcatcaaatatctagacagcaatcacatttcctcaactgtcttatacttctgttgagcttgaataaagatcctaagaagttccatactttgcatctgtgtagacatgggagaatcatcaggcatagctgaccatgtaaaaaatgaatcgttaaacctgatgccaagagccaactcattagaaaagaccctgatgctagaaagattgagggcaggaggagaaggggacaacagaggctaagatggttggatggcatcaccgactcaaaagagatgagtttgagccaactccaggagatggggaaggacagggaagcctggtgtgttgtggtttatggggttgcaaggagtcggacacgactcagtgactgaacaacagcaaaaggaacaaggctatgaactagtgtttgatgactctgatgctcccttccaatatccgggaggacatctgttcatgcagtcattccacagatattttctgctatgcgacaggtaccagtcaaggctgaattaagagctttcctgaacataaaagaagttgtgccagatgatggtgaccagtgaagccaatacactattaatagtatcccactcagcagagaggttggccaactttctcagtcaagtgccagggtgaatttaggctctgacaggtcagacagcccccaacataactgctcagctggcctgttgcagcatgggagcagcactgggcagtccatcaatagatggggaaactgtgttctgataaaactttttaaattgaagaatagttgatttacaatactgtgttagattcaggtgtgtgtgtgtgtgtgtatatatatacctttgcatgcatggtgctaagttatttcattcgtgtctgactctgtgtgaccccatggaccgtagcccgtcaggctcctctgtctgtggggttctccaggccagaatactggagtgggttgccgtgccctcctctaggggatcttcccaactcagggatcgaacctgtgtctcttatgtctcctgcagtatcaggtgggttctttaccactagcgccacctgggaaacccgtatatacattctttttttttttattttttttattttttcgtatatacattctttttcaaattcttttccattataggttattttaagtcccctatgctacagagtaggtccttgctacttatctattttatatatagtagtatgtatctgttaatcccacactcctaatttctctctcccctttctctactatggtaaccttaaatttgttttcgatatctgtgaatctgtttgttttataagttcatttgtattatagatttaaattccccatgtaagtaatatcatataatatctatcgttcactgtctggcttacttcatttagtgtgacaatctccaggtccacccacactgtggcaaatggcattattccattcttttttaatggctgagtaatattctattatgtatgataatatctattatgtgatgcgtgtacacacacatcacagttctgataaaactttatgtacaaaaacaggtcgatggccggatttgacctgcaggctgtggtttagcaactccctagtgtagcaaatcaccctcccctagccccagcctctgtggacagtactctggtttgaccatcacacccatctgggtgctggttatttaggctgagaggcaggacttaggcgcatggagtcagtaccgcttagcaaagagcaaagtgcaaacgttaaaggaatttgtacccaagtccccttaccattccgatagtgttcgaaccaaggtgctgttgcccaggcagaaacgaggcccccgagcttagctcgaacacgtaaagagatgttgaaacgccgtgggaacccctccgagaggctgtttgcggtaaagtcacactctgtcctggtgaggttcgtacaatccaccttgctatcttctttgttgacatcataccagttactactggtgctgctgcaaacggaaaaaaggatttcacttagcagaaatctctctttgatcacagatcacagttcccccagggttgagtttttaaaaaatttttttcattgagatattcctcacatatcacacactgctctcacttaaggggacagttcaatggctttcagtatatgcgcagggtggtgcaaccctccgcatacccgttttagaatattttcatcatcccccaaacaacccccatgcttagagcatcactaggctaccaccgatctatttcctatctctaaggatttgcttgttctggcacttcatagaaatgggatcataactgatgtggtcttttgtgattagtgcctttcacttagcctgttttacttagtatgttttcaagtgtgatacatgttgtagcacgtatcagtactttatcccctcttatggccaaattaacgtccggttgcatgtttatccattcatgttctgacggacaggtgggctgtcttttggctatttgtcttttggcttattcactttttggctactgtgaataatgctaagaatattcacatataaatttttgtgtgaaattatgtttccagttctctggggtgtatacccagaaatgaacttaccaggtcatatagttactctctttttaactgttttccaaagcagctgcatcatcttatgttcccggccacaatgtataagggttccgttttctccacatcctcaccaaggcttgttattatgacctttttattgaagccattcaagcgtctgtattttctctggtgactaatgatgttgggtatcttttcatgtacttactggctatttgcataacttctttggaaaaccgtctactcaaatcctgtgtctctattttgatttggctatttgccttttaattgctgagttgtaagagttcttttatatgatatattctggatacaagtcccttattagatatatggtttgcaaatattttctcccattttgttccacagccaatgttaatgcttcaaactcagcctctgtagcctatgtcttagaaccgatactgtgttcatgcaaccacaccccagtttctcactggtgtagagctttgttttcaccccatagttgcccatttaaaaagagtcatggacttccctggtggtacagtggataggaatctccctgccagtgcaggggacaagggttcgatccctggtctggggagatttcacatgctgcggagcaactaagcctgtgtgtgccacaggctactgagcctgtactctggagcccgccagcctcaactactgagcccacgggctgcaatgccttaagttgcaagcctacagtacgtggtctccaacaagataagcaagcacagtgagaagcccacacgatgcaatgaagagcagcccaccgctcgttgcaaatggagaaagcctgcacaacaacgaagacccagtgcaaccaggaaagaataaaccatttgtaaaaaatagagtcctgcccacaaggaaaccttgctgcctgtaaggccatgcatccttgtaactgagaatgtaccccctgttccgataccacatgcccatgcgggattctattactaatccccgactctgagctctgtcctaaggtgacagacttgagaaaaggccgaggggtgactccagaagcctcagtgggggcagcagggagtgtccccttgagagacaggctgtgccctggacagcaactctggcctggaaagcagggccaggggagacaggagagatgaggctggggtcacagccaccagctctcccacaccacgtgggcttctaagggtctctctgacccagtctggagactcagcttctgctaaagtggcaggtaacccgatgaaagtgatatcaatacatgtggccaaggcttccaccgaagatgcccaccagactcacacaccactgtaccttggagtcctgggacctaattgggaaagggatcacaaaccacaggcgccccctctcagactgggggctgtgctacagaagcaggtgggtgattttttttttaaagttacacagatacctgaaggtactctcaccttctccctgccaattccagctgttgaactggggcaaaaggccccctctgggattagccggggaactgacctaccatgttccacctcctcccctctcctccaaacttgtccgttttggatttatcccaaggatgcaaggattttttccaatattcacaaattaatcagtgatatgccacatcaacaaactgaagaacaaaaaccataccatcatctcaacagatgaagaaaaagcttttgacaaaatttaacagccatttatgataaaaaaaactctccagaaagtgggcatagagggaacacatggcaacacaacataggccatttatgacaaacctacagctaacatcacagtcagtggtgaaaagctgaaagcatttcctctaagatcaggcacaggacaaggatgtccactctcagcactttttaaacacagttatggaagtcctagctacagcaatcagagaagaaaaagagataaaaggaatccagattggaaaagaataggttaaactgtcactgttgcagatgacacgacattacacacagaaaatcctaaagatgctaccagaaaactactagagctcataaatgaacttggtaaagttgcaggttacaaaattaatacacagaaatctgttgcatttctgtatgttatttctgtacattcagaactacttttttaaagtgtttcttaagaacggggtttaaaacggcacaaaccatccaaatttaaatgacagctgacactgtttggctccccatctatttgtaaagggtaaaaataaattgctgtgggccccatttaaatggataatgcaatgaacacagcctcatggcatgacaccgcccaggcctggagccccagcctcttgccccagcctatgatgaatcagccagtctgagcaatacccagcaagcggtcctggctcctggcaatgtgttcatatggacagcctctgtcccccaatttgtctaattttgaaagcaacctcaatcatgagagggagcacagcctcgtgattaaacacatggactctagagccagaatacccaggttcaaacccagttacttcacttctctgttcctcagtctcttgatctataagatggggatgcgctagagcatctgattcttaggattgtcttgaaggttgatctcgtggacaagaggaaaatgcctggaccagggcctggggtttctactcagttcagttcagttgctcagtcatgtccgactctttgcgaccccatggactgcagcacaccaggcttccctgtccatcaccaactcctggagcttactcaaactcatggagtcactgatgccatccaaccatctcatcctctgtcatccccttctcctcctgccttcaatctttcccagcatcagggtcttttcaaatgaaaaggcagcggtgcctactaagcaccatctaaaaatatttattaacaacctgagcaaccaatgatttccctgttcaccttctgttacatcatttccagaaatgattaagtaagtctgtcctctgtgaacccagcaagtcctcttccagaaatggatgaaaacagtcatcaatgatttcggtttgaggacattacttttaatagtcacaaactgtcaactacaccactcgtgggtggggaaaagtaaaaaaaaaaaaatcatgagtgatacatcatataacaaaacataaaataaaaatgttcacactgaaataactgtaggaaaaaatattcacaagcttaactacattaagttaaaaggggaaaaaaaaggaagcaggacccagaggtgtgactctagtcttgtttcagtctcacacagatgctggcatatttgcaaacaagtccatgtatttagaaaaaacgtctagagagaaatacactaaaacaagaatagtgatttgtcttggaccccaggttgctttaattttgtactttttacttttctgggttttccagattttctataaagaaggtgctttgctattaaaattagaaaaacgtgaagttaagagaaaaaagtgaagttaagaaaaaaggggttgggaagactggggtgggcaggccctggcgtggcaagaggccaagtggggtgtgacctagaaagggcccggctctctgcctgcctttattttcaagaaaaaacagaaattcggttctttttttaaagtgaaatttccagatttgtaaatgttaacactagttaggaaaacaacaacagcaacaacaacaaaaaaccattgtgggccaaacagactctaggccagaggatctgccacctcagatttaaacttaaaattttcgcacaatgtgttctatgtaattttggctttgctggcatgactgtcaaaaaatgaaggcacattcatttaaagttacagtgatgtttcctggagagaaacagaatggaaaatttaaagttccatgagcctcagaattaaattacttcatgtaactaaaaggtcctaaacttgtgaaagtatctaaaaacagaccagcaaaaaaaatcaaaggccctcttccacaatcaagtctgtaatttgaaaagaaaacataaaaattcgcctctgtttgagttttcatgagccctcagcttttccaaacagggatgatgcgtgaatgcgtgtgcatgctgtcgctcgtcgtgtccgactctgtgacaccatggactacagcccgccaggttcctctgtctgtgggattctccagagaagaatactggagtgggttaccatttcctcctctaggggaatcttcctgacccagggatcaaagccaaatctcttacgtttcctgcactggagggcgggttctttaccactagaacgctaaacaggaacattcacattcaactctgtttcctttaccaaaaccagcccctaacctgaaaaaaatatcttacaaaatgctttcccaatagaaaacagagtgaaacaggttagtctgtgatgtgaaaccgtcaaaggctttaataaatccttctagtgtccagaggccctctgtcaactcataaatgtacttccccaatcaaggctgacaagtgctagtgggtagatcagctgcgacttcctcttactgcaacctttgggcagcgctctaggagactgtgttcactgaaggttgagcggggccagctctaagcaggtggccggtgcagtggcacagagctgtactcctaagagggttcctgacttcaagctctgatgttgccatcctgaactccccaaagtttttgaaccaggagccccacgttttcatttggtactgcgcacaaaatgatgtatctggtcctcacggacaggtctgtttattacagatgatcatgtttgaaatttaccatcacttaagaagtagatagggatttccctggcggtccagtggttgggactttgccttccagtgcaggggaggtgggtttgatccccagtctgggagctaagatccccaatgccttgaggccaaaaacccaaaacgtaaaacagaagcaatattacaacaaatttaataaagattttagaatactaaaaccaccttaaaaatctctctaaaaaatagacatagataaatgcaatccagagataggcctcaaatctcagtttagaattaatttttacaatgtgctcagtcatgtctgaccgtttgtggtcccatggacagtagcctgccaggctcctctggccatggaattttccaggcaagaatattggagctgggtgccatttcctaccccggggatcttcccaacccagggtgtgtcttgcatctgttctgataggcagactgtttaccactagtgacacctgggaaggccatcatttttttaagcaaatattgttacactgaacagttaaagataaaaaagaagtcctctggaaacctcctcctctaacaaattaaccacttgtaatttttccacatgccctacctgttctgaccacagattcattccaaattggatacagctgcacctgctgtcatatgacacataattacccttttcagtggtccctaagggctcattcacaagttaacttgacacaattcgtcaacttctagccaatggacatgaatagacacttgaatgtatatcttcatgagtgtaagtttgtttggtttctttttttttgatacagaaggttgtattgtctgcctggaataaaaaaagtagtatggacattcccacgattctaaatgaagagaacaactgacttttcaagagggctgtgctcacaactgattctgattcagcgtgtgtccaccagccacattctcaccagcactaggcattcccactgttaaaacttttgtttatttagtaatctaaaaatgacttagccaataatttttgtttgtttgtttcggctgcacctcagggcatgtgggattttggttccctgaccagggatcaaatctctgccccgagtattagaagcatgcagtcctaaacgctggaccacaagggaagtctcacaataattttaacttggtcttcacttaatgcatctaccaaggtaaacgacggcttggattttgcctttctccttcctctgtgtgtctacattgtaaatcaagtgatggccaactgtaggaaggcttgaacaggaggtgagggagagaatgaggggccagaataaaatgcaaaatggatcaccagcttagaaactgggaattaattgttcattaattgaacagctttcttattaggccaaattcgggccagaaggctaaataatccagattttgaaacctgaagacgatgaagaccaaaagatacctctggccctttccagacaggaagctctttcatacaatctccgccttaaactgatgaatcaacttccacacaactaagctgtcctgtggtgagacagctgagctccctgagggtcaatatcctttcagccttcggatgagtggaggggttggaggggaagttgtgaaatctccatccttggagatttaagaagtacaagagagggacgtccctggtggtccagtggttaagattctgggcttccaatccagcgggtgtaggtttgatccctgagccgggaactaagttctcacatgctgcacagggtgtggccaaaaaataaaaagtccgagaggactatctgcttgtgacgactttgcttacagtgctgccaaggagcaagaacaggcagctggcctcaggttctgtaacaattccactcccagctcccaggaagaaggccaacagaaacattgcttactatttatactgcacctggtagaccaccggcctcgggtcgctgtccagggacaccggctcccagctcagcgcctgctgggcgttgtacaggtgaaccttcaggtttccaggagcaggcagctgggccagggagtcttgaaagggacagagaataagagaaggagggagatgagggagagacagggagggtcaagaggagaaaagtcaattacaaaaatatgtaattcatgcggctggggttttgatattacccattctccccacacatcccctacgcctttagcctttgactaaagacagcccttcaccctagaaatggcatatgggggttcccttggctctcttccctggagattgcatgaagggttccctcaactttcttatcttggtttaactatttgttaatcccataattgatgcttttgaactgtggctttggagaagactcttgagagtcccttgggctacaaggagatccaaccagtccatcctaaaggaaatcacccctgaatattcactggaaggactgacgttgaagctgaagctccaatactttggccacctgatgcaaagagctgactcatttgaaaagaccctgatgctgggaaagattgaaggcaggaggagaaggggatgacagaggatgagatggttggatggcatcaccgacttgatggacatgaatttgagcaaactctgggagacagtgaaggacagggaagtctggtatgctgcagtccatggggttgcaaagagttggacataactgagcgaatgaacaacaaaagatggcacagttgacacagtctgtggggaaaggggcttggggctgcctttccaactgcaggttccagttccatatgagcaggtcctggctgaggcttaatgaggacacctgtctacctttaggagtagtagtgttagtcgcccagtcatgtccaactctctgtgaccccttggcctataacccaccagactcctctgtccatgggattctccaggcaagaatactggagtgggtggccattcccttctccaggggatcttcccaacccagggatcaaacctgggtctccagcactgcaggcagattctttactatctgagctacagggaagtagaggctggtatggtcccacaggggaattggtaggtggcagggggagaggaaggagaaaggcttccctgaccaggaattgaacccaggtcacagcggtgagactgcctgtagtaagtgagggtaacataagagcttgggccttggtttcttcttcaggaataaagaataaaccatagtacactggagaaggttctggagaagattaacttgatggctactggacaagcatgagaccctgactttgatataaggaatatttgggaaatctccacaaatgtgtacacacacaccccaaaccagatgtgcaaatcccaaagacacctgggagggtgaggacttgtcttctgggcttcatgtgtttctcaaagactcccccaacgtcataatcactgaggctaaaatacagattcccatgccccaccccagaccaggaactctgcattttcaacaagcttcccagctaattcgcatgcacgttgagacgtttgagaaccacaaatggcagaagaacacgttctgcagggaaccactgccaatgtcagaatctcccctccttggcatggcccgtgatctacaggacggggctagaggccaccagggtggaaggcttttctctcgtgaggaaacacatggtgatgataaggctttctctgagaccaaaaggttaatgagaaacacccagagctggaaagtctgaaaaacaggctattccagagttccaagcaggaaattcaaaacacacattttcagtaaatgcatctcaaagaaggatgccaagaccagctgagagcctggcccaccgtgctcctgctgaaagaagttgtggcctggagtctgtggccacctgtttacttacagaatgcccatcactttcacagctaaggcctggggctgaccttccttccagaccttaattcaaccagctaccttgacactccagccaactcatgtcaggcctgacggaagccggcccaaagatgcagcgtggcgggaggctgctcttccagactggcccaccctgctcactggggctgctatggcccagtggatcccaatgtgagctcaggaaatgaagtcctgcttccaggagatgctgtgcagggtctcagggggtgagggcttggttagggctgggcacgggaccagccaggaaggccaatgtagtgtcttaacccggattcatgctcttattgttcctacaggtcagacaacaggtctcacaggccaaggtcaaggtgttggcatgctccctttcttctggaagccaggggagaaatagttcctgcctatttccttgctgagaagctgctcacattctttggctcctggcctcttgctccagcaatgctgggctgagcctgtcttgtgctgccagctctttggttccgacttcctcttccagcttccaaggatccatgtgattgcactgggcccactgagcccaataatccaggaaaatctccccagctcaggaaccctcatttaatcacatctgccaagtcccttttgccacgtaaggcaacgtggtcacaggctccggagatcgggctgtggatctctctagggaccattattctgcctgcctccccctccctggggaggatttaggaggcatcccctctctctccacctccctccccacccccatctagacagtccgctaagaaggggagcactagggaccaccgatgtcttccagcccgccaggcaggcagaccggaggacagccttctcagtaaatatcaggagtctccatcagagccttccgctttctgcacctttcatgtaacagaggtgtggccaggggacctgcagcctggctctcatatttgagtttgttggcatcccctgtttcactgcattcagagaagaaaccgagtctcggggctgtgggtttcacgctgaagcaccagaggctgccctctcactcacaccagcagcctcagttcggccccgcgcatgcatcatctcaggagggaggcccgttcctgcccggcctcccctggccacctcctcgccccaggggatggatggtgggggcaggagggggggcccttgcacttcgccctgcctttctctggagccttctttctccctgggccacgcttctcccccactcccttcagtactctgctcaagcgccaccctatcaaagcactttcctgcctcccaatccccctttcctttctcctgggtttcccaccacctgggtttcccaccacctgggtcctgtgtttacacccggggggtggtgaggaggaccagaatttgactgcctgggttcaaaggcccatgctcttcgcaggaccttcgggtgcgaaacctcctgctcttggcagaaccttgtttcacctctctgtgcctcggtcgtctcatctgcgaaacagcaatgatcactgtgcagacttcaaagggttcttaggaggagtgagcgggttaatttcacgtgtgctgctgagacctgcaggagcacagcgtgaccggttcctcttcctcagatgctagagcgggagctccagggaggctggctgttgccagacttgggggctgtcccatcccctggagctggagaagcaggctcctggggcctggggaacaacggagctgtagcccagtaacctgctgtctctccttcagggattaagcagccagtttctgcatttgtccaggagaaatccaggctaagctcaagctctctttcttgctttatgtgtaagtcctgccttttctctggtctcggagaggctggggcaggaagtgggtacaattctgcttgccgttgttcgctcactaagtatctgactctttgtgaccccgttgactgtaccccgccaggctcctctgtccttcactatctcctggactttgctcaaactcatatccattgagttggtgatgccatccaaccatctcatcctctgtcgcccccttctcctcctgccctcaatcctttcccagggtcttttccgatgagttggttcttcacatcaggtggccaaagtactggggcttcagcttcagcatcagtccttccaatgaataatcggggttgatttccttaaagattgactaactctggacttatctggatggctctaaagggtccatatatttagggccatatgacctgcagtcaatggtgttaacaaaggctttgggaagagaagagaatttgtgggcaaaaggctttagctggaatcctgatcctgccaccaagaaccatggaatcctgccacaacacacctgagcatcaatttccacatgaaaagtgaaatgacaccatctctcctagagatggagtgagtgaggggcaaatgcaggaccacaaatgaaaggcaaaccagacaccaaaccacacactgctgcctaagtgtgatttttaagatgtgcctggtggctcagacagtaaagaatctgcccgcaatgtgggagacctgggttctatccctgggtcgggaagatctcctggagaaggaaatggcaacccactccagtatgcttgcctggaaaatcccatgaacagaggagccagtgggctacaagtctatggggttgcagagagtcagacgtgacttagcgactaaacaacaacagtttcagggtgtcctgatggatggctgcaggtagtgagctgcaagctgttacccagaccaagcctccagtgaccaccaacagagggctcagcctgtgctgactgctgggtcaatggtctgacctcgcgtgaggcaaaacagcgccctcccctcaagacgtctgtgtcttatgaacatattaggtacatggggatcggagttgcagatgaaacttagggccctacagaagatctaaagacagcttatcctggagcatctgggtggacccaggtcaccactgtttctccaggagctggaaaacgcaaggaaatgattctccctctagaatcctcagaaacgaacacacccctaggacaccttgatttagcctcagcccggtctgcatctgaccacgacttccagaactgtaagacactgaattcagttctaggtatcaaggaagtgacaacccattccagtattcttgcttggaaaatcccatggacagaggagcctggcaggccacagtccttggggctgcaaagaatcggacacgactgagtgactaccacacatcttcaccgtaagcttctttaccgcaagcatttccactgcagacactttcactgaataactaacgggccgtaaggcaatttagcttatgtaagttgtaaaagtaaatttcacaaatctcttttgataaaagtaaattttatcaaaaggaaaatgatgaaaaataaaagagaaacataacattggccataatgaaacatgaaaaataaacaacaaaatttaaaagactattgcaaaatgaaaaacatttgaatacatttaaaatgtgtgtagattcacagcaatactgtgcaaacaactgattttattctgtgggctttacgaagtactggtcttcaaagtcttttcttttgtttcttatcatatatacatattttttgtgtgtgtgtattgatttgtctcatggtttttctttttcactgacatttcttcttttgttaagcaaggtgtcagcttctaaacattgggacacgtatttgtaactgagctttggaccgtgtgtgctggcatattgtcacatgtctgttgataaatatttagttctatgggaagcattggttcaactctgcacctttaattaaggccatcggcctctttctctcccagggtagtgtgtttcctaataagaacaccaagtcatcatcatccatcaacttgataaagccatcagcaacttcactacgaaatgctttcacatttcaaccacttgaaaccaaactgtcaaaccaagttgtcagccagttattttatctattatggcaaaactgcctgatgccaattagtcatgtactgaaaatgtctgaggttgaaaatgcttgtggcaaaggtatctatggcaaagaaactcacagcaaagacaccaggcacaaataagtttgtgctatattaaggcaccaagttggtggtcattgttacagcaacaacaggaaactaacacagtccagggaggtggacaccaggcctttaatggcaccctagctcctacaagataaagctcacagtcctaagaagggtgcacaaagccccactctgcttccttctccatggtctttggggcaatggttcactgttaatggtaagaagagagaacctagggagatgccaaatgtatcttccatacaattactgtacaatcacacctcctgttccacctttctgccccaactggctacctccggtccaccctggatccaggtgtttgagattttatacatttttaagaacaggctctcctgggtcttaatagcctagtttgattaacacatatcacacacagataataaagtactactaacatcagaattaatcatttaatcttcacaatcgaagaccccttccctcctgaaaccccctccccctgaagggtgactgactcgtgttgctgtcgtatggcagaaaccagctcaacattgtgaagcaattatcctccaataaaaaacatgcaacaacaaaaaagaagacccttcaggatccttccatggatgggtcattatgatgaacatcagtgatcccatctccaattaataccttgcaggtgaggagaagtaaaaaacaaaaaactccctgaattctcacccataaccaggaagttggtcttgtccgtaaatactggatatcagcttatctacctagaccatttgtctcttcctaaaaagaatggtttgatttcctagggagcaaaatggggttattatctacttcaaaagaatggcttaacagcctgtccgcgttaaaagagtagcccaataaatggtggccactatggtcatttatagagtttgcccccaaacattcctattacgtattactttccactgttgaggttatggacaaacaggagttccttaatatacattaatttgctatggtttttcctatggttggggatttactatttttctcagtggtctctaagctctgagaagctttggatgttcaagtcagcaagttacggtaagagaattttgtggccttaagtactaaatacttctatcaacctctggaccacagcagacaaatcacaaacaattcacagactagtcaggagcagcccatgtatagaggaccaccttggaaaattaccaacacccgaatctcatctgagggcttccctgagctttccctttcccttctcacctgagtagtaaagaatctgcctgcagtgcaggagacatgagacctgggctcagtccctgggttgggaagatcctctggaggagagaatggctacccactgcagtgttcttgcctggagggttccatggacagaagagcctggcagtccatggggtcacaaagtgtcagacacgactgagtggctaagcacaaatctcatctgaaggaagcccagggaaggagcaaatgtaggttgttcaagactcgaagcttgaggagtagagttaagatacaaacccatctgtccagctcccaggaggaaacagccatttaactaggagcacacaaggggatgacagaggacgagatggttggacggcatcaccaactcagtggacacgagtttgagtaaactccgggaggcctgatgtgcagtagtccatggggtcgcaaagagtcagggacgactgagcgactgaactgaactgaactcactccctgagtgctccccagatggcttagcagtaaggaatcagcttgcaatgcaggagacaatgcagtccaaagggtgggaaagagtcggacatcagggagcgtgggagtacacacacacacacacacacacacacacacacacacactctctctctctctctctctctctctctctctcactcccctctcacacacacatacactcacacatacacacactcacacatacacacactctctctgatgcaatgcttcccttatccaggacctatggagtttaatggcgttgcaagggatgctgataaaaagaaacaagcccaaacaacagcttgagaatccaagggggaggaaacttctaaattcttgagacttttaaagtgttactcaaactatggtatcagtcacttcatgagaaataagccagcaaaacacaaacacagagtgatgcacagagagaatgttctcaaccacctttttcctttctctctgtctctctctctctctgtgtctctctcttggtagtttgtccctggctcataggtatggtcagttagtgtcagaggtaaacaggaggctgagcttaggtggggcagtccagatgggaacagcgctaggattaaaattctggctcagctgacccgctgcccaccgcagggcaacatttctgggttttgcgccgccgccccactccccctcctccgccggccagtctatccgaccccgggggaatgaccacctggacttcacacccgctaatcagacacacccggcctcagttaagattgaggtacagtcacgatccccaggacagaggtccccgccggtggcaggcctccctggcacggaactgcgaggaaagcaggcctggacctggttctggctgcgccccaccccagggaggagaggccaggcagcgctacattcaggcggtcgggaagaggaatctgtggccggcggaagcagcctcttctcgagccctgaatctggtttttcctctgctcatttggagacattcagagtcgagccgcgctagctttgggggcttctctcttaagagaaggagctacagactgtccagactcgtgcaggggcagcgcggcccggggctcctcccgccgctacagctcgcggcccgagactgcctggaatccaccctccccaccaccccccgcgaccatcccacacccgcttcgggctcccacgccccgcggagcccacccgatcggggcagccctgaaccccttccactgatcctggctccccgcggaccccacccgcacgggacacccctgtttactgccccccccaatcaatgggggttcccgtggattcccacctactgcgggctccccgcggactcccactctcgagacgccgcctccggcaggcctcggggtcactccggccccgcttacctgcggggggcgccgcagcgccaaagccgctgagcatcagaagcagcggcggcagcagtgtcggcggcggcggccgcatggcccagggctccgggcgccgcacgctccgcggcgctgggggcgcagcccggccccggcgcggggtcgccgagccgctcacttcgccgcctcggcggccatggcgaccgcagggcgcgcgcggggcccgcctcttcccgagccccgccggctgcagcggcggcagcgcgtcctggggcggacgagcgccccgcgcggccgccgcgcccgggcccggccctcctggagcgtgccccgcccctgcaccccgcccgccgccgggactttcctggcgccccctacccgcgccggcgctcccgggaaccgcggccccaggggtccccgggctctccgcggcccgagcgccccgcgcggctctgcgcgagccggggtctccctgaggggctggcgtcacccagcaagcgcagagccggctggccccgaccttggctcagaggagccgggggaagagggaaccctgccacccgccgccttctgtgctggggacgacgggttgcggctcgcgatccttcgggaaagacccctcggcaaccagagccccggatgggcctcgcgcggagccctcgaccctcaccccacccccatcttcgcccactgccccccgatttcctgggattgcacaattccagagttcctcccttaggctgaagcttttgcttgtttatcagactttcaagtacatatttagcttttaacccttttttgacagtagggtcgaagggtataggggttggaaagagccttggaaagactgattgaaggaggggagctttgggagctctgggcgcccggcaaggcgaggcagagggacccgccccacatttcataatggtctgtggctttggcccgggggcaggccgtgaagaagtctatgaggaagtgaccccgggagctgggggtgcgggggtgggagtctgagttggcttttatccgttggatgccagcaaggatttgagtccattctgttctctcaatatgagccataaaccaagttcagcaggaaaggaaggaggcataaaagggaggttggggggaggctggggtggggttgcggatgggggcgggcgggaccaaggaaagggatcacgagtcccctcggatcgtgctggacatcctgtgggtggcttggcagcgcactattccgtaagtcagtcaagctttgcttttggacaaaacggagaactcttttgaaattggccactcttgtaaacagaggtgctgagatatctagcagtgtttgaatgatgcttagagtgagtttttccaagacaaagacatggtttaaatgttaagtgaaaacagcagaatccttgcaaaaatgacgcgttgagaatggctgggggaaatacgccaaaacactggcctgaaatagggtgtgggattacagaatgataacagggtttctttactttcttcttcttcttttttttttttttcttaggcttttttctttttcccccaatgggcatattttccttttataatcaggaaaaaaaaaatcaagttaaagaaaaggacacatgtgtttgtgcctcagcccaggccagggaaggctggtggtcttccttgatgtggaatgctcaggggcagcgacagtgaagcctgtggtctttgagggttcttggaaaccccctgacaatctccttccagagcttttctctgctaaaatgtagagggtttatgttttccttacagttcctggcaaagtactaaaaggagccctacccagttcgctgcttgggtggaccttctgctgacaccccaggcatgtactatccccaaagcaagtaactatcccgcccacccccgacatcaaggcagctcgccaaagacaatttctctcagggactggcatttctgcttcctctttctcctggctgagagactgcgaagtcttggagagatgactgggatttccacagaatcctcaatctgaagagaataggaagcgagtctcactggaattggctgtgaaggatgtccagcaaccactgtcctttggttccatctctgcccagccagagcatcatgttagagctgagtttattgggtgtaacctttgtaagtgggtgaccctctggctcccctttggaggcaggtttactgagaaaccactgaaagcaaacacctcagaggctctcctttccacaacctcgtccacggccgtagaagggactccccgcacttggtcatatgcttttgtgaaatctgccaagtaagagcttttaaccacagtcgttcagacatctgtctctttcctcatcaacttctcctttaacacacttcgagaccatgcaggatggtgttggggtgcctgtggtgttttccagaactgtcttgacatgatacagcagtagcattgtgaagttaaatgacacttttctaaactgtcaatacgaagaaacattttgattaaatcattctagaggaaaagactgaattaacattttgttctttctatacagcatattttatgtatttatttttaaatattattattaattttttggctgcgctgcatgcctccttgcaggaccttggttccctgaccagggattgaacccttgccccctgcaatggagtcctaagcactgcaccgccagaaaattccctagagcatattttaaaggattgttgcatgtagaggccacaattacacaatcaaatgtgtagataaaagagtattttggggccatgccttgggaaatgcaggatcttagttctcccaccaggtattgaaccctgaagtggaagcacagtcttaaccactgaactgccagggaagcccaaaagagcgttaaagaggtatgtcaggcggttaactaacacaggtattctattttccggaatttttgcaatgttagtggtattcagcagctttaaaaatgtgtaacttgtgatttattttgtaatgcgaagtgaatacttttgtgcctgactttatactcttagttgggtattctttatgggtattatatgaacaaacaaatttcagccttacaaaacctgaattgcctcattcctttccgttaatctgctaccttctgacctgctgatcttcctgaaatgttttccttatatgaataatctagaggtgctgccctccccgccctcaggagggtgggagaggggtggagaaagaagcccacattggttgatggcttgggtgcttctgcatgtgttttaccacttcgggctgccatgattgccgtgtcacagatgaggacaccgagaagaattaagtaacttgccttgaggtgaatttatatggtatctgtggcatcttaagtcttcccagttggcgctagtggtaaagaacccgcctgccaatgcaggagacgtaagagaagcaggttcgatccttgggtcaggaagatcccctggaggagggtatggcaacccagtccagtgttcttgcctggagaatcccatggacagaggagcctggagggctatagtccatggggttgcaaaaagtcagacatgactgagcatatactatcatggagtcctgtaccaaggccacagaagtagagccacaagcagcaccatctctggaaaggactgagcccctttgtaactgttgccaaaagtcccccagcaggcatcctgaccccatattaggcaaaaatgcccacagtagtgctcactgtaggcgccctaaccaaccttccaccaggaattttcttggtcttgaggctgtaagaactggcagctaacccaggaaatgtgtcgactctccttggtctattaggaggttgccccactgtgctcaaagtgcccttatctctgctctttgttcttaatacactcattcccccctgaaatgctgtgtgtctgaaaattcctttccaaccgccctccgactgccatgacagtatgcattgagctaagccaaaactgcttttcctcaaatttccttcttgcagagttctgaattagcatggaccagcggatttttttttttttttttaaacaggatttagaaggtagaatgtggccattctcctctcaggagactggggcggggcgagagggattgctgctgctcacagtattgtggcttatctactggtgtcctgtagaacagggaggtagccagtctcgacgtttcctccagcatctgctgctatggcttccctgtctcctgagccaggtgcccatttagctccttgacaaaagcatccccttttcctgcaaggcaccctgctggagacttggagatagtgagagactgatggtgggttgagcatgtccttgtacccccctcctttcgtccaccttctcttccccctcctgcccagactgcagcaccagatacagaaaaaaaaaaaagtcttacacagattatgtagccaacttccctgatttatttatttgtaaaatagttctttctttatctgactgtgccgggtcttagttatggcacgtggggtctttgatctttgttgtgggcgtccctggtggctcaatgggtaaagaatctgccagcgatgagggagacctgggttcgacccctgggttgggaagatcccctggagaaaggcatggcaacccactccagtattcttgcctggagaatccccatggaaagaggagcctggcgggctgcagttcacggggtcgcaaagagttggacaggactgagcgactgagcacacagcacagtggcatgagggatctttagttgtagcatgagaactctctaattgtggcatgtgggatttagttccctgacctgggatcgaacccaggccccatgcattgggatgtaagatcttagccactggaccaccagggaagtccctcccatgatttcttaacatcaagtcacacacacacacattgcagggtggttttgtttctctgatcaaaatctaactgatcatattcccaaattacacagcacctaggggtgcactcctagccagtcctggctagcactggagccctttgcatctcaggccaaacttctcatcgtgccttttcaattcccccaatcaaacctggctctgaccacccccgtcatacttttgaggctcaccaacaagatcctgcttttctatcatgagactttaaggatgtttaaaagtgaagtatacttgatttgcaatgttgtgttagttgcaggtatacagcaaagtgattcaaatacacatatatattcttttttttctattcttttccattttaggttattgcaagataatgaatattgtttcctgtgctatacagcagatcttttttgggggggggcatcttccacgtggcatgtggtatcttagttcccagaccagggatcaaacccacgtcacctgcattggaagctcagagtgttaaccactggacaaccagggaagtcccagtaaatccttcttctttatctgttttctatatggtagtgtgtatctgtgaatcccatactcctaatttatccctcctccaccatccatccagcatccaccaaagaattgatgcttttgaactgtggtgttagagaagacacttgagagtcccttggacaacaagaagatcaaaccaatcaatcctaaaagaaatcagtcccatatattcattggagggactgatgctgaagctgaagctccaacactttggccacctgatgcgaagagccaactcactggaaaagacgctgatgctgggagaaagatcgaaggcagaaggagaaagaagggggagacagaggatgagatggttggatggcatcactgactcaatgcgcatgaatgtgagcaagctctgggagatggtgaaggacctggaagcctggtgtgctgcagtccatggagttgcaaggaatcggacacaacttagcaactgaacaccaccaccatccgtgagtctttgaagacgaacttcttaaaagctgagtgtgctctacttttcttcctacgctgtctgccccgcctgcgcacccctcttatttccttaacttctccctgcttcctccctccccaaacccacaatctaagttctaaacctccatttcttgtctgagcttccacttcttgaggactttgtcgctgtcccagtttagcatcttctactgctgcacagcgtctcgtgtcacggtggatccctgctgagacagacaccttcagagtgtgggcaggtgagtgcccctgtcagtcaaaccgagcagcaagagctccaaactcgaagtaggccctgaccattgcttgacggggtgtcctctgagccaagaaattccagcagtaggatcaggggaactggcacagaagtaaaaggatacattcagctgggtctctagtgaccccgtcctgtctcctcatggagtccaagcttgctctgctcgccgcacaatagaccagtgtatctgagagacgaggtgttgaggcagggaagagactttaatcagagagccggaaggctagcacctcaaaataaccatcttattggggtctggaggccaggttcttttatagattagaggtgagggggtggtgaggatgcaaagttaaaaggccaagaatctagcaaacatttcctagagcggcaagcctcagggcaggggatgtgttaattcgtccttcctgccatccgcaggtggacagggttctgaacagaagcgccttagttcaacagtcaggcagacggtttacctctccgaggcaaaccgttctgcatgattatggaaaccgaagccacgaaaggcgagtcaaagaagaagttctactatggagtcagaattggcgtcctccctgcaacacttactgtgtccatcgagggccacagcgccttccattccattccctgctagtgttgcctttctgcttccccggtggggccatggcaaaaactccatccgaagaagtcagactattttcttctctcttccttcccttgccagggtaactgttttaaaacgtgatactctgcatttccctcctctgggaaacaggaaatgaatacctgaaaatttggcaagaagagagagtgcagagagaaggaaatgtgcaggtcctttgaacccctataaaaggagaagttacatctacatattatgtaaatatcaaagctttaatattcctgcctctggcgagtcccttgggaaagcccaaaaaaggggcccaggccttctggaagctgcccgtgggaactgggaggggctggcaggagatgtctccactgattttctggacagggtttgtgtaactaattcagaggaactcagatggatctctgttttctgggaaggctgagatcatatcattatccttccatgtgtaaacttgccacctgggtcctgcagacttccaggaagaacctggtaggtaggttggacaggaataagagtggctcattaagagacaggcctagatgaggcagtggctgctgtgaatcagctcagtgcagctgggtggtgtcaccagagcctctgatgagtcatcattgacaccattagcaaagcggaatcaggcctcagatcaaatcagatcagatcagtcactcagtcgtgtccgactctttgccatcccatgaatcgcagcacgccaggcctccctgtccatcaccaactcctggagttcactgagactcacgtccatcgagtcagtgatgccatccagccatctcatcctctggcgtccccttctcctcatgcccccaatccctcccagcatcagagtcttatccaatgagtcaactcattgcatgaggtggccaaagtactggagtttcagctttagcatcattccttccaaagaaatcccagggctgatctccttcagaatggactggttagatctccttacagtccaagggactctcaagagtcttctccaacactacaattcaaaagcatcaattcttcagctgtcagccttcttcacagtccaactctcacatccatacatgaccacaggaaaaaccatagccttgactagatgaacctttgttggcaaagtaatgtctctgcttttcaatatgctatctaggttggtcataactttccttccaaggagtaagcgtcttttaatttcatggctgcagtcaccatctgcagtgattttggagcccagaaaaataaagtctgacactgtttccactgtttccccatctatttcccatgaagtgatgggattggatgccatgatcttcgttttctgaatgttgagctttaagccaactttttcactctcctctttcactttcatcaagaggcttttgagttcctcttcactttctgccataagggtggtgtcatctgcatatctgaggttattgatatttctcccagcaatcttgattccagcttgtgtttcttccagtccagcgtttctcatgatgtactctgcatataagttaaataaacagggtgaccatatagccttgacgaactccttttcctatttggaatcagtctgttgttccatgtccagttctaactgttgcttcctgacctgcatacaaatttcccaagaggcagatcaggtggtctggtattcccatctctttcagaattttccacagtttattgtgatgcacaccgtcaaaggctttggcataatcaataaagcagaaatagatgcttttctggaactttcttgctttttccatgatccagcagatgttggcaatttgatctctggttcccctgccttttctaaaaccagtttgaacatcaggaagttcacagttcacatattgctgaagcctggcttggagaattttgagcattactttactggcatgtgagatgagtgcaattgtgcggtagtttgagcattctttggcattgcctttctttgggattggaatgaaaactgaccttttccagtcctgtggccactgctgagttttccaaatttgctggcacattgaatgcagcactttcacagcatcatctttcaggatttggaatagctcaactggaattccatcacctccactagctttgttcatagtgatgctttctaaggcccacttgacttcacattccaggatgtctggctctaagtcagggatcacaccatcgtgattatctgggtcgtgaagatcttttttgtacagttcttctgtgtattcttgctatctcttctttatatcttctgcttctgttaggtccataccatttctgtcctttatcgagcccatctttgcatgaaatgttcctttggtatctctgattttcttgaagagatccctagtctttcccattctgttgttttcctctatttctttgcattaatcgctgaagaaggctttcttatctcttcatgctattctttgaaactctgcattcagatgtttatatctttccttttctcctttgcttttcacttctcttcttttcacagctatttgtaaggcctccccagagagccattttgcttttttgcgtttcttttccatggggatggtcttgatccctgtctcctgtacaatatcacgaacctcattccatagttcatcaggcactctatctatcagatctaggcccttaaatctatttctcacttctactgtataattataagggatttgatttaggtaatacctgaatggtctagcggttttccctactttcttcaatttaagtctgaatttggcaataaggagttcatggtctgagccacagtcagctcctggtcttgtttttgctgaccgtatagagcttctccatctttagctgcaaagaatataatcagtttgatttcggtgttgaccatctggtgatgtccatgtgtagagtcttctcttgtgttgttggaagagggtgtttgctatgaccagtgcattctcttggcaaaactctattagtctttgccctgcttcattccatattccaaggccaaatttgcctgttactccaggtgtttcttgacttcctatttttgcattccagtcccctataatgaaaaggacatcttttttgggtgttagttctaaaaggtcttgtaggtcttcatagaaccgttcaacttcagcttcttcagcgttattggttggggcatagacttggattactgtgatactgaatggtttgccttggaaacaaacagagatcattctgttgtttttgggattgcatccaagtactgcattttggactcttttgttgaccatgatggccactccatttcttctgagggattcctgcctgcagtagtagatataatggtcatctgagttaaattcacccattccagtccatttcagttcgctgattcctagaatgtcgacattcactcttgccatctcttgtttgacctcttccaatttgccttgattcgtggacctgacattccaggttcctatgcaatattgctctttatagcatcggaccttgcttctatcaccagtcacatgcacagttgggtattctttttgctttggctccatcccttcattctttctggagttatttctccactaatctccagtagcatattgggcacctactgacctggggagtttctctttcagtatcctatcattttgccttttcatactgttcacggggttctcaaggcaagaatactgaagtggtttgccattcccttctccagtggaccacattctgtcagatctctccaccatgacctgcccgtcttgggttgccccacgggcatggcttagtttgagttagacaaggctgtggtcctagtgtgattagattgactagttttctgtgagtatggattcagtgtgttagccctctgatgccctcttgcaacacctaccgtcttacttgggtttctcttaccttgggcatggggtatctcttcacggctgctccagcaaagggcagccactgctccttaccttggaccaggggttatctcctcaccgccgcccttcctgaccttcaacgtgggatagctcctctaggccctcctgcgcccgcacagccacggctccttggacatggggttggtcctcccggccaccgcccctggcctcgggcttaggggcgtggggtagctccttcagcccgctgcccctggtctgggacttggggcgtggggtatgtcctcccggccgctgcccctgacctcggacgtggggtaactcctctcgtcgccacccctgacctcggacgctgggtatctcctctcggctgcccccacctgacctcggacacagggtagctcctctgggccattcctgcgccgtcgcagtctagtactctaggccactgcccttgacctcagacgtggggtaactcctcttggccgccgcccttagggcatggggtcctcctggcttctgcccctgaccttggacatggggtggctcctctcggctgcgcttagcgcgcagccgcctgcacttcagagcgcccatcgcagccacctgcgctttttgggaatcaggcgtacaccctcctataagagatcctgctttgggcatctctccacctcatcgcaagcctttgaggtcagggcagtgattgttctgctcagcactgttgtgcttgatgtttttaatatttattgattgatttttggctgctctgggtcttttttgctacactcacactttctctagttgcagtgcatggaagtgcagtgaagtgaaagtcgctcagttgtgtccgactctttgcgaccccatggactatccaatccatggaattctccaggcagaatactggagtgggtagcctttcccttctccaggggaatcttcccaacccagggatcaaatccagatctcctgcattgcaggcagatttttttttttttttaccagctgaaccaccagggaagcccaacaatactggagtgggtagcctacccttgaccagcagatcttcccgacccaggaatcaacctggggtctcctgcactgcaggcgaattctttaccagctgagcaacgtggactctggagcaaggcctgagtatgggctcagtagctgtggtgcacagaattagttgccctgagacacgtgagatccttccagaccagggatcgaacccatgtctcctgcattggccggcagatttttagccactggagcattagggaagtccccactcagcacgttttgagcacccttagtatatctgggaagttctcagtcttatcagtcctgccccttctagaaaactccagatcccagcccccatcactgtcctgttagtctgagccaagtctccttctctgagctgaaaaatcttgaaaaattttacatctaagaaccaccaggagttccccctcagatctcagtttttcagtgatttctcatgagggattcacttcgtggtacagcagaaagtagtgcaacattgtaaagcaactatacctcaattaaaagaaaaaaaaaaaacaacaacgagggggtggaaatcacttgaagacattaaaaaaatactcatgagggaaatcagccccatataatcaaaagaattttatgttatgtgtcctaaaattaacacatattattccacctagctggcctataactgagacaccaaaagattttgttatttacttgagtcttaattcttttacagttcattatttcactcttataaatgcttatcttcattgtaataaatcttttggggaagaaagactgaaaaaaaaaagggaaagaagtctttggaaacacaaactgctaaaaggtctctctagcccaaattctaataatcagcccccttaaaattgcttgccaaaggcaaatacagattttgaaagacttgaacaaatactgaaaggctttagtcatccaaatgagtaaacgatttatttcaactgacttttataaactagtgagttttctatcgtacctaatttataactaaagctttaaaatgaaaactaaggagaaaaaaaaacacatattattctaattctctttctctgtaaacatttatatgaatatcctttcagatatattctttaccttgttcacggattccttttgttttaaaacatatatttgatttttttttgagacatgtattctaatttgatactgttactctttgtgtttgcaaaatgtatactggaactactgagattaaaagatgcttgctccttggaagggaagctagacagtgtattaaagagcaaaaacatcactttgccaaaaaaggtccatatagtcaaagctgcggtttttccagtagttgtgtatggatgtgaggattggaccataaagaaggctgagcaccaaagaattgatgctttcaaactgtggtgctggagaagactcttgaggttcccttggacagcgaggagatcaaaccaatcagtcctaaaggaaatcaaccctgaatattcatgggaaggactgaagctccagtactttggccacctggtgtgaagaactgactcattggaaaagaccctgacgctgggaaagattgagggcaggaggagaagggagaggcagaggatgagatggttagatagcatcactgacttcctgcatatgagtttgagcaaactctgggagatagtgaaggacaggagagcctggcttgctgctgtctatggggttgaaaggacttagccactgaacgttgaacttaccaggacttatcaactgaacaacaaaaatactggaacctcttgtcagatgtatactgtttgtctgggagaaacaaagacctttcttctctttgtgtctgtttttagagaggtgttacggactgaatgtgtcctttccaaactcatacataaaaaccccaaccctccatcctctccacccaacccacatcgggatagaatttggagtcggggcctgtggaaattaattagggttaggtggggccctgcggatggggggtgcctatggtgagactaatgacttttctataagccagtgtcaacctaaataaacctatcaggcattaatcaagcaaaaaatgtttatttgggatcaaagacttgcaattcagagcgcacagattccagcagcatttttaaacagtgtcttgctgctgctgctgctgctgctgctaagtcgcttcagtcgtgtccgactctgtgcaaccccagagacagcagcccaccaggctcccccgtccctgggattctccaggcaagaacactggagtgggttgccatttccttctccaaagcatgaaagtgaaacgtgaaagtgaagttgctcagtcgtgtctgactcttagtgaccccatggactgcagcccaccaggcccctccgtccatgggattttccaggcaagagtgctggagtggggtgccattgccttctccaaagagtgtcttactagagactaaaagtcaggggcttttaaaggcaaaggaagaagcttgaattacaaagaattttaattaagagttggaagcagaagctagtcttggctaaacaacattgagtgccaaggctctcactcaagggagtaagggttgcttcctgtgacaagttgcgggtgttcttgcagagtgcttggaatatttatggtttcccagttcaaaagttcatgattccacctggtgcagacgagtgtaaaggtcaacctctttaatggcctcctagtttccttttaaaaaacctcttgacataacttcattttatttcacatttcataccaggaagagagctctaaccagaacccaaccatgctgatactctggtcacagatttccagccccacagctgggacagtttcagttgtttaaaccacctgttgctgttcagttgccaagtcacatcctactctttgcgaccccatgcaccgcagcacgccaggctgccctgtccttcactacctcctggagtttgctcaaactcgtgcccattgagtcggtgatgccatccaactatctcatcctctgttgcccccttctcctgccctcaatcattcccagcattggggtttttttcccagtgaggcactcctctcatcaggtggccaaagtattggagcttcagcattagtccttccaatgaatattcaagattgatttcctttaggaactacctagtcttatggtattttgttatggtggcctgggctaagacaaagggtcttgatctctggctatgacaatgtgtatagaagagctcataaaacaggtgtcaggaactcaagtgaataagtcacctggcttctgttcagtggaggcccctctcactttacacagattatttagggaacagcaataggcacatttttggaagttagtgcttgggctgtcaggatataatctcctctgaagaactaagtcccaggtaatgcagttcctgttctacaagtcactcagaagttgccagtcagcatttctgcgtcagaactgcattgccacatggagggaatacagttccagccacaagtaaagaaacctgatgttttaacccatctgggaagccttcctgagggcaaatgaatgattcccctggggctttgtgaattggtgagtccgttctaggggctttcattccttccatcgatgattccaatgatgcatggacccaggctgggacctctgagctctcagatggttgacccaagagcccctcctctccatgtggaatcctgcctgggatcccctcttcttgggagctgaatgactttcttattgatgtggtaagaaattttcccaaacttagtggcttaatggacatgaaatcaagcaaatttcaaaagattgtgaaggacagagaaacctggcatgctgcaggccgtggggtcgcaaacagacttagagactgagcaacaacaacagaagctggaagtccacaacaggttaacagggctgccttccttctggagattctaggggaaatcagtttccttgccttttctcacttctagaggctgcctgcattccttggcttgtagcctcttcctctgtctttaaagccagcattgtagtgtctgcaactctctccagtctctggtgctggagctgaagcgccaatcctttggccacctgatgcgaagagctggctcattggaaaagaccttgatgctgggaaagactgaaggcaggaggagaagggggcagcagaggatgagatggttggatggcatcaccgactcaagggacatgagtttgagcaagctccgggagctggtgaaggagagggaggcatggtgtgctgcagtccatggggtcgcaaagagccagacacgactgacaacaacagcaataccatcatagatctatttgttaagccttttcatatattaggatatgcattcaacataatattcaatatttgtatatgttgcaaaatgacctctacagtaaatctacttaatatccatcaccacacagttatagaatttctttcttgtgatgagaacttttaagatctactctcagcatcttgtaagtatgtaataccatattattaactatagctacctgcacattatgtcctgaagacttaattgttttaaaactggatgtttgtaccttctgatcgccctcacaagtttcaccccaccccctgcctctgaaaaccaccaatctgttctctgtacttatgggttcagttttttctttcttcttcttcttctttttgaagattttatatataattgagatcatatggtgtctttctatgtttgacttatttcacctgacatggtaccttcaaggcccatccaggttgtcacacatgggaggatctccttctttttttacagctgaataatattccattgtatatataccacattttctttattcatacctccatcaatgaacacagacccttttctgacactcctgccccaccccattccttataaggatccttatgattacattgggttcagttcagttcatgctcagtcgtgtctgactctttgcgaccccatggatcgcagcacaccaggcctccctgtccatcaccaactcccggagttcactcagactcaagtccatcgagtcagtgatgccatccagccatctcatcctctgtcatccccttctcctgccaccctcaatctttcccagcatcagagtcttttcaaatgaatcagctctatgcatcaggtgggccagtgaacacccaggactgatctcctttaggatggcctcgttggacctccttgcagtccaagggactctcaagagtcttctccaacaccacagttcaaaagcatcagttctttggcactcagctttcttcacagtccaactctcacatccatacatgaccacaggaaaaaccatagccttgactagatggaactttgttggcaatgtaatgtctctgcttttcaatatgctgtctaggttggtcataactttccttccaaggagcaagcgtcttttaatttcatggctccagtcaccatctgcagtgattttggagcccccaaaataaagtcagccactgtttccccatccatttgccatgaagtgatgggaccggatgccatgatctttgttttctgaatgttgagctttaagccagctttttcactctcctctttcactttcatcaagaggctcttgagttcttcttcactttctgccataagggtggtgtcatctgcatacctgttatcgatacttctccaggcaatcttgattccagcttgtgcttcttccagcccagcgtttctcatgatgtactctgcatacattggatacccatataattgaggaaaatctccccatctcaagatccttaacctaatcacacctgcaaagtccattttgccaagtaagataacatatacataggctgtggggattaggatgtgggcaaatttggggaccattattcagcccaccacaggggctgcacagaatgacaccagacaggtcggtagacactctcagcatctctgctttggcctcttccaccaattcagtcttgcatggcacctgcaacccagcacacccacacctctacagtctggcatcctcaggttggccagtataccaacacccccctgtctctcaaaatctgaaggctgcgacccttgcagggctgttcttcctggggctggcattcatccttttcttgttaaactcagtgcagcattagcttggcgggtgtaaaagcctaccttaaaaaaaaagaggggatagaagaattaacctcgttttctggagcttggcaacccactccagtattcttgcctgggaaatcccacagatagaagagcatggcaggctatagtccacagggttgcaaaaagttggacacgacttagcaactaaacaacaagtggagcttggagttgggacatgtgagggtggaaaagatttgtggcacttcctagtaacctgtatatactcatttgcaaacaagactctgactttctggttgcaaaagtgcacttgttgggccaagatgagagcggtgctggccagtcattctgtctgctggcagggaagagaaaggcttattgggaacagcaggcttcttcatttaattcctccttcactgccaacaattcgttctgggtacacattcctcttgaaagggctcgtgccagagttgagacttccaggaaaagctggagtttgatgtgataatgccagtcagccagatcagtactctggcttagcttgggcaggaactattaaacatcagctgatttcttgaacttaataagaaaaaaatgccatacctcattctctagaatgttaaggcacctagagtaataaatacactatatcataatttataacaaatgcatgtatgttttttaaatgacatacagttgacttaggatactgtgttattttcaggtatatagcaaagtgatttggttatacgtatatttctctatatacatatgttttcaattcttttccattacagtttattacaagatatttcatatagctccatgtgtcatatagttaagcccttgtttattattttcaaaaatatttatttatttggctgcaccaggtcttaattgctgcacgctggatctttagctaaggcacatgggatccagttccccgaccagggatcgaaccccagccccgctgcgttgggagcttagggtcttagccactggaacaccaggtctctatctgttttctatgtggtaatgtgcttctcttactcccatgctcccaatgtatccttccctcatatgatgtgtttttaatgtaaagatttgtaaatcaaaaagaatacatggtataaaatattaggttaagaaattatgtgttgatgttgttgagtcactaagtcgtgtccgactcttttgcagtccccttgactatagtctgctaggctcctctgtccatggagttctccaggcaagaacgctggagtgggttgccatttccttctccaggggctctttcctaccgagggattgaacctgcacctcctgcattgccaggcggattcttcaccactgagtcaccggggaagccctcagaaattataggcctgtggaaaatgtatgtctaggacattaagtcagagactgtgctgtggtggggggtggagtgtatgcccacatgcagtcaaaaagtcctacacattcaccaaaatcagcttccttgcaactaacataaaaaccaggttgctcaatgtccaaagatgcatagtatctgaggaaaaagcaacccagttggatttctgctccagacaaggacaactttggcatttggtgggcccttagtgcttccccagtggctcagcaggaaagaatgcaggagactcaggagaggtgggtttgaccgctggagaagggcatggcaccccactccagtattcttgtctagaaaatcccacggacagagaagcctggcgggctacggtccatggggttgccaaagagttggacgagactgagcacgcgtgcaggacgaatgcaagggcccttagtttagctaacttaccctggaattttaattgattcggaacttttaaatttaacaaatacacacaagctcttatcattgttttcccttttataataatatttaatcactctcatgaatctataaaatacttaaaaataataaagaagagaaaatactcccccgtagtcttacaacccagaaataaccacagtttacatcttggaatgtctaaattcttgagcaccattaaaaagcaaggaggcaacattatttcaccatttttgagaagactggagaaaccgcatcaggatggaatagaaaggaatctttcgtttctcacatgcttgtttttcgtgacggtgcaaaaaacaggctgcttatggttttacgagattatacagatagttctgactctgccaagtcccacccatgtcttgggccatgtgaaccacgtctcctgtattggcaggcagattcttaaccactgagccaccagggaagcccttcaaggcatcgttcactcttcagcaaccttccaacttaagcctttggtcacctgactcctttcgggcatggccatgcaaagtcgtgggcatttgtgctgcaagccgagacctgggggtcagcctacgtttcatggtgttacatgcctgtgaacttctatggtggactcaaactattttcattttttcttaaaacattttcactggagtagagttggtttacagtgttgtgttagtttctgctgtatatcaaagtgaatcagttacatagacacatatatccactttttttaaggatgctattcacatataggccattgcagagtgttgagtagagttccctgtgccatacagtaggttctcatcagttatctattttatatctagcactgtgtcaatcccaatctcccagtttatcccttcccctgccctttcccccgttggtaactgaaagttcgttttctacatctgtgactctatttctgctttgtaagttcatttgtaccattcctttagagtccacatataagcgatatcataaaaaaaagaaagattgtcatcgtgagatttcctttccatttccccttgaaacttcaaacaccatacttaggtgatctacatagaaaacaaaccagaacaaaacaagtgcaaactcacttcagtacatttgttagcgacggcaagaccagaaagggtccaggaggtgatgctcagaaagcacaaggctttcaactgtgtgtctttcccccccttcccacgctccttccttcctcatgccagttcttccttttttccttccttctcttattcatttaacatttattaagcacctactccacgccaggccctgttctgaacacaacaaagactctgagttggtggagtttacattttagcagaggtgacagagggcaccccaggcaacccccaaacgcagtgcctcgtgtctcggacaacggtggacctgggacccagaggacggtgggtccgactggactccgtcccaggtgacctcggggtctgcagagcggatgatgcgagaatcccttctctccctctgttccagcactggtggccgggccccagttctctggaccctctgtgtgtgtgtgtgggatggggaaccccaggtaggagccctgagggaccccttatgctgtgccagagaggtagcgccccacacagcttttcatagttgcctactatagcttgaagggcttcccaggtggctcagtggtagagaatccacctgccagtgcaggagacgcaggttcaatccctgggtcgggatgatcccctggaggaggtcatggcaacccactccagtcttcttgcctggagaatcccgtggacagaggagcctggcgggctacagtccgtggagttgcaaaagaattggacatgactgagtgactaaacaacagtagctcaaagaaaatactaactcaggcgcttgggaggtgttccccaaaggtcagttcaaagggtctcaccacgagctcacattcccaccaccttccctgacttgggggaagacctcttgcctgacaaccttggcttttccagggtatgtggtagggggggccacccttctctgctgtcactgtccttgcctaatacccagggacctgggtacagccgtaaactcttccatactgcctccccccagatggcacgggggcacctatgcagatgaagcctcagaatcttcctggacgacgtcactcaagaccaagggaagctcttgtttttttcagacattacactgtcccaggaagcaaacagtcctaaagaactttgattccgatgaagtcaactaaccctgaagtgttgacttactcaagtttccatagaaaggaatcctcagcaaatatttatcagcactccctgtgcgacaggcattattccagagacttgagaccaggcactgtaactaaatggaaacatcaacatagcctccgacctgctacaagaaattgtgtcatttaaacaggaagactagtgggcaaaacaaattactgaaaataatctgcacttcctgacctagataaatctctccatcagcctaaagaatgcatctgttagaaaagtgggcactgctatgtgctcgtttggccacacccagaaacagaaccatcgcatcacttttgctatgtcagtccaatccagtctatgcccaactttccagggctctagagttgggcaagaccgaaaagtcagagaaggcaatggcaccccactcctgtactctcgcctggaaaatcccatggacagaggagcctggtaggctgcagtccacggggtcgctaagagccggatacgactgaatgacttcactttgacttttcactttcatgcattggagaaggaaatggcaacccactccagtgttcttgcctggagaatcccagggacgggggaccctggtgggctgccgtctatggggtcgcacagagtcggacacgactgaagcgactgagcagtagcagcagcagcagagttgggcaagacagcaaacggagaagagggcagcagaggatgagatggttagttagatcgaatcactcaatggacatgaatctgagcaaactcgggggggacagtgaaggacaggagagcctggcaggctacagtccatagggtcacaaagagtcggacacgacttggagcctgaacaacaaaagagttggacaaagcccaggaaatgtgaggagagcgggctggcattcaatctgctgggtacacggctaagatgctcactggtccattcaaagcctgtgaatcctcatccattgtgctccctctgaacatccctagcaaacccgggcatccacatccggggcctcgcttctcctgccccccgccccccatgctcctcaccagcggcaagagaagggccctggtgtctctacagacagtccttgtgcaaacgtttcctgcgcccatcttccaccccaaactacagcaatgtcaacatcagggcaaacacagagcagaagagaccaattctagcccacgaattaaattcctctttagtgccctctgtgaaacagtttagtcttatttccgagaattaaaaataccggccttctgttcaaccttgcgtttagaaatcgccgtgacggaaaaggaaagggccccacaggcgacaatggaaagcctgagagatgatacaacctatgatggggaaggcagcactaggaggtgacatctgttttgttgttactcttaaacaacatagatgtagtttcttgcccattatttagagggataatattttttttttttaatttaaagcacagcacctgtgataaaatgtggttttccttgagtaactgtcattgggtcctttttttacatgcaaagtgtatattttggataattttcagttcagttcagtcgctcagtcatgtccgactctttgcgaccccatgtatcacagcacgccaggcctccctgtccatcaccaactcccagaggtcactcagactcacgtccatcgagtcagtggtgccatccagccatttcatcctctggcgtccccttctcttgccctcaatccctcccagcatcagagtcttttccagtgagtcaactctttctcatgaggtggccaaagtactggagtttcagcttcagcatcattccctccaaagaaatcccagggctgatctccttcagaatggactggttggatctccttgcagtccaagggactctcaagagtcttcaaaagcatcaattctttggcgctcagccttcttcacagtccaactctcacatccatacctgaccacaggaaaaaccatagccttgactggacacacctttgttgaaactaatgtctctgcttttgaatatgctatctaggttggtcataactttccttccaaggagtaagcgtcttttaatttcatggctgcagtcaccatctgcagtgattttggagcccagaaaaataaagtctgacactgtttccactgtttccccatctatttcccatgaagtgatgggactggatgccatgatcttagatttatagaattatagggttatagatttataggttctgtctgtggagaagcctccgcacagacagtgcagagggttctgtacgcccctcatccagcttcagtttctcctaaagttaacatcttatgtttgtcaaaacctggaaaccaaactgacacctcattattaactaaaatccacactttatttggatttcatcagtttccacattaacatcctttttctgtaccaggagtcagttcagggtaccatattacattacactggattctttttgaagtggcagatgtaggattacataaagggtagaattaattatatgttgtcttggtattgaaatttggacatatttcttgttgactgtggtttgctttttgaaaataaaccagatcaaagacaaacacctggatttgtcccttacaagcaagctatttcaaagaggggaaactttatttttatttttttatatttagtggctgtcctgggggctcagatgtcaaagaatccacctgcaatgtgggagacccggattgggatgatcctctggagaaggaaatggcaacctgctccagtattcttacctggaaaatccccatggacagaggagccttgcaggctgcagtccatagggtcgcagagaggtggacacgactgagtcactaagcacagtgcacagttttatttttaatacttagttttatttatttatttggctgttccaggtcttagtcaggatgttcaaactcttagctgtggcacgtgggatctagttcgctcaccagggatcaaacctgggccctctgcattgggagcatggagtcttagccactggaccaccagggaactacctaaggggagaaattaaatgtcttataatctcgacaggctttactttaaagttgtgcccaatgaagaaactttggcagtgatggacattcattatttttatcgtggagatggtttcacatgtgtaaaaacgcatccgggggcttccctggtggctcagtgatacagaatcctcctgccaacgcgcgagacacgagttcgatccctggtccaagaagatccctcccactatggagcagctaagccagtgtgccacgcgactgagcctgtgctcttgagtccaggagccgcaactacggagcctgtgtgctgtaactgctgaatcccgagcagcctagaatccatgctctgcaacgagagaagccactgcaatgaggggcccgaataccccaactagagagtgacccccggatgctgcaacgagagaaaacgccctcacagcagtgaagacccagcacaaccaaagataaacacattttaaaacttcaaaactcattcgaaggtacacttccaatgtgcacaaaggcacagcttcatgtgtacaagtcatactgcaatcaagctgaaaataaacaaaagaattgcgtgtcatgcgtaagatcttaagatagggttgcaaaatgcttcgttaatgattgccaaggcatcagattattctacatattccagaggtcaaattctaccttttataaaacctcagtgagaggacattctaactctaaagatattccatctttaacgtgaattaggagtttctcccttggaaatcagacctggacccatatgaaaaatgatcccaatttaaccctagtggctctgatcccttaaggtgtttccaagaactgggcaaactccagcgtctctttgagtttggcgataccaacaacccagtgatgtcatatgcaaactggggctcaccctacctgcctggccaaaggtcactggggctgataagaagtggcaatgtgccaagaagccggagccatctccactgagaattgaatatgtcacatttcaggctcatgttgaaggatttaaaaaaaacaaatagaataaaataattaggtcatgggaaaatgcagtagatatagtgagtgtgtgtgtgtgtgtgtgtgtgcttagtccaactctttgtgaccccgtggactgtagcccaccagactcctctgtccacgggattctccaggcaagaaagttggagtgggttgctatttccttctccagggcctcttcctgacccaggcagggatcaaacctgtgtcttttatgtctcctgcgttggcaagcgggttctttactgtctgagccactagggaagactcaaaatacaggtgtgcaattctaatccataaatccaaaatccaaagagctttgaagattgcagactttcataactcacgacctgagttaacacaaggctatatagtgtttaattatgccacgcagtgtgaaaggcatgcatttcccttgagactggtaaatggtatgactgtctttgatgtaggtatgtgtacccgacactgctgtaggtaggtactatgtggtatcacccgcagcaggtcactttttttcccccttaattaggtttttaaaaaacttttaatttttatattggactataaccaagttgtgatagtttcaggtaaacagccaggggactcagccacacataagcatgtatccattctcctccaaactcccctcccatccaggctgccacatatcactgagcagagttccgtgctatatatatcaaggtcaggtcacaactctaaaaccccaaattgcaaaacatgactgacctgcggtttccaggtaaaaggttgtgtgtctgtgctggtgaccactcccattgattacacatctgtacgtgatgtatcttggagaaccttctcagtcgtccttgtaaagacgaacttggcttccccttcttacttgaggctctccatcagaggtcagagtctacattggaaacaacagaacccatcctagctagatcagatggaagacaactgtctgaaagggtgttaggaagcagaatccttgaagaggcagaaaccagatctggggtacttcatggtcactctgggcattctactggacacgctcttttcctaaagcctcgctgttcttttcctaccacctcgaggtggtaaactgggtgatttttgctcttgtggtaggaaaaaaaaaaaacttgtcagatttgtatcctttaaccatgaatgacgttgactatcttttgtctaggagcgtttgagtttccttttctatgaactgtctgatcacatctttaacctttttttggaaaactccaaaaaggaagctcaaatgttcttaacaaaattcagtcaatcccatatatagtcgaaagatacaaatctgacaagttttttgatttgtattagtgatattagccccttcagtcagatggttcgtgacaatttttcctatatagaaataagtaattttttaagttaataattttagaacaataaaatactatataactggaaatgaatgagtcagagccaagttggcagatagagactgatgtcttggctggagcaagtgaaaaatctcaggggcaagggggtgtgtatagcaaatcccattaatagataaaagaatatggttgtgcatgtactggatatcctgtaaagacatacaagaaaatactaatgccggttcagggcattgtttctgtatgcttatataccctttagacaaacatttttttaatttcatgatctgtggatatgttaccttctaaaaaaagatcaatcatttaatgcaattaaagtgataactccttccctttctgcttctgaattttttgtttcctcagaaagaaatggattctgtagtttaacattgttagcagatccattcatgctttcttctaagactttcattgttttctgtttatttaattgtaattcatagttatgtaaagaataaagttaagatctccgtcctgtttttccttttggcattttaattgagatactcctgcatatagaaagtcatttggtgagaattgatgtgtattagaagaaccaagggggatctttctatttattcaagtcttcttttgttttcttcaaaataatcccttacagttcttgctaagtttatgccttagcatttcatcttttgatgcgctgttacaatgactgtagaagagatctccccttccattatgtttatttgtttttctaatacggagtgccttttttttttaaggcctaattctttttattttatttttttaaatataaatgtatttattttaattggaggctaattactaggaagtgctttttaatgtttttgtccttctgaaagaaggtataggtattggaagtaatacatgtacagctttttaaaaaccgagaagtaattgacatataacatagtgttagttttaggtgtgcaacacaatgatttgatatatgtatatgttataaaatgatcaccacaacaggtttagtttgcactcatcactacaactttttgtttgtgtgtatgatgaaaaattttcagagcaactcccttagtacttttcagatgtacaaggttgctaactcctagtcaccacgctgtatatgatatccccaggacttattcatctcgttcctggaagtgtggacctttggctgcctttcacccattttgctccgaaccttatcctctgtctctggcaaccaccagtctcctttcagtatctaggaggtggttcctttattttgttttagattccatggtgagtgagatcatacagtatttgtctttctctgtctgactcatctcatggtgcatctgacttagcatgatgctctcaaagttcatcgatgttgttgtaactggcaggctcgcctttttttatggatgaacaatattgcagccatggtatcgatttgaactggttcttgtttctctgctagaaatgtgcgtgttatagattacttttgcaatgcgttccatgattgaatgtcctgactgtttctaattcttttctcactgattgtcttcaattcctctccttcactctcacatcgtcttcagcgggaatgacttggcctcctctttcacctgccatcacgtaacattcggatgaagcccatgttcttatgtgatgtttccagagacctaaaaacgcacagacccgaatggcactttggtgtttctaaacggtggcacggcctcagctggccgggggtccaggcatgaggcttcggatggttgacatttgtgattttgccctcttgcccagcctgcttgtgaacaaatagatagctgctcctctgtctccgagctctggacaggacttagactggggggcttggcggccagtgtacagcactggttatttaacgcatctccccttagcgtgctggcagggctgccccaaaggagagtggtatgtgagcagtaggattctttgtttttttgtttaatatttattcatttatttggctgcgccgagtcttcgttgtggcacttggactcttcgacctttgttgtggcccgggagatctttagtcgcaacatgtgggctctagctccctgaccagggattgaaccctggcccctctgcattgggagtgcaaagtcttagctactgtaccactggggaagtctggagcagtaggattctgaagagtcttactcttgcctggaaggaggtgggccctaaaaaggtgctgggggctggaggatgggggacccctaggacagactttaccacttaactctgaggtcagtttcaccatccaaaatggcagagcaaggactggaaattcttgagaatttcagcaactccctaggagtcgaaggggagagatgactcattaaggaggggacttgggtttctcagctggtggttccttcaggggcgttcccctccacctctggggccagagaaataggagagcaagtttcccagagggggcactgtggggcaatgaaggcgcctgaactgctgggtccctcagggaaggtggactctcagggcagggagggtctgggctcctccttggggaggagagaggggaaccgtggtcaggaggcgagcccagacccttgatcctggtggccagtccctgccccacacacccactgggcaggacctgccctcctgggagcacgttccactaaagctggaggaagttcagatggcaaaggaaggaggtgcaatggcagctgaagggccctgaacatgcttagctaaacagagcttggattctcccgatggcagcatcaaacagaccttggaatgtgtcatcagtcagccccagagctggtgaagagctggcaggaaagagaacgcagagatttgtctctcccaaggcacgtgtttcggcaagcccacactgcgcggagcctaggcggttatgcaactgccttgtcagttgagctcaacccgcttcatgaaaatagccatctagctcacatcacactatgtgctgctatgtggttgacgtgagaagacacttttaccagtggttaaagccctttggatttttcactgttgaagacaaagcgacatgtggttattatgttataaccacacagtatcaaaggttgcttaactaagtgtgaaagtcatcgtaagcactgcaaacatcaagaaactcaggaaactattcctcgaagccgtctgaatacagccagtactgggtagaaatcaagtagcttcttctcaggtcaagatcaggtgctaaagcccccgcccagggtgctgagaaatcagaccttggtgaaacagtctcctttgtacattttttttaaaatttttagttgaagtgtagttgatttataacgttgtgttaatttccgctgtgcagcaaagtgactcagttacacacatatgtacgttcttcgttcttttttagattcttctccattatggtttatttcaggagactggctacagttcccggtgctattcagtaggacctcgttgtttatccagtctatatgcaatagtttgcatctactaatcccgaactcccatctccccaactcccccttggcaatcatcagtctgttctctacgtctgtgagtctatgtccgttttgtagattggttcatttccacaataccttagattccacatagaagtgatatcacatggtatttatctttctctttctgcttacgtcacttagtctgataatctctaggtccatctatgtttctgcaaaaggcattatttctttctgtttcatggctgagtagtattccattgtatatgtgtatgctgtactttctaaggtcccagagaaaagcaattgagaggttcttgatcattttgttgagacataggggagtttacagtgggagaggtggacctggtttccttccagaagtaaatgtaaataaagaactcaagtgatgtcaaaccaaccaatatggaagaactgatcaggcacatgatattccagagggtgtaaaatgataacatagactatgcctccagggtcttgcaatgacataggagaactagatgggaacacaaagaaggcagaggaggaagatggcaaaggagttcttagaacgaggggtctggtcactgctgaagagcgaaaagatgggagaggttggaccaaagcgtggggtgtggctgccgggaagagcagcggctttcagagagccacccgcaaagaagccagatagagagggactcatcagtgagtgggtgtgaggatgctgagaaaagtgtggtgatggggcacggtggtgaacccaggaagtggtaaggctcagaaatttgtgttgttttttttttttttttaaagtagagggagacctggagatgtttacagatggggaggaggcatcggtggaggagggattaaaggtacagaacatgtgacaatgatcaccaagccctctccatgccccgtgtgcagacctagccatgcttcttaactgctggaacacattcagagcacgagtgtttcatcacttgatgagcattgttttgagttttgtttgtcttacaatgggaacctatgaatatttgtgaggttagaaacaagagccagaagatgtgtttgctgaggtctaccttgtttcataggtcagcaaatttggaaaactcagcagtggccacaggactggaaaaggtcagttttcattccaatcccaaagaaaggcaatgccaaagaatgctcaaactaccgcacaattgcactcatctcacacactagcaaaataatgctcaaaattctccaagccaggcttcaacagtacatgaaccatgaacttccagatgttcaagctggttttagaaaaggcagaggaaccagagatcaattgccaacatccgttggattatcgaaaaagcaagagaattccagaaaaatatctatttctgctttattgactatgccaaagcctttgactgtgtggatgactacaaactgtgcaaaaattttaaagagatgggaataccagactacctgacctgcctcttgagaaatctatatgcaggtcaggaagcaacagttagaactggacatggaacaacagactggttccaaatagaaaaaggagtacgtcaaggctatatattgtcaccctgcttatttaacttctatgcagagtacatcatgagaaatgctgggttggaggaagcacaagctggaatcaagattgctgggagaaatatcaataacctcagatatgcagatgacaccacctttatggcagaaagcaaagaagaactaaagggcctcttgatgaaagtgaaagaggagagtgaaatgttggcctaaagctcaacattcagaaaactaagatcatggccatctggtcccatcacttcatgggaaatagatggggaaatagatggggaaacagtggaaacagtgagagactttatttttgggggctccaaaatcactgcagatggtgattgcagccatgaaattaaaagacacttacttcttggaaggaaagttatgaccaacctaaaccgcatattaaaaagcagagacattactttgccaacaaaggtctgtctagtcaaggctatggtttttccagtggtcatgtatggatgtgagagttggactataaagaaagctgagcaccaaagaattgatgcttttgaactgtggtgttggagaagaccttgagagtctcttggactgcaaggagatccaaccagtccatcttaaaggaaatcagtcctgaatgttcattggaaggactgatgctgaagctgaaactccaatcctttggccacctgatgcgaattactggctcatttgaaaagaccctgattctgggaaaaattgaaggcaggaggagaaggggtcgacagtggatgagatggttggatggcaccatggacttgatggacgtgagtttgagcaagttccaggagttggtgatggacagggaagcctggtgtgctgtgattcatggggtcgcaaagagtcggccatgacttagggattaaaaaacagccttgctatgcggacaagtcaccgaagcccacagtttgcttgtctccgaaatgagggtcctcacagtgattgggctggttaaccgcctgcctccccacaatcccagcaggtttcctgctctcctcccctcagcgtgaatgggtgcgtcttcctagagcttaactgtacctcagtctgtagctgacgttgtgactgaaatgtaccaggctctgcagggtgcctcatggtcctggctaagctgggatggagcgtttcctcagatgagggactttcagccctgaaactgaggtgaggagatttgccctatcacatgctctgctccagtgttttgcagaagtcaagggtataatcgctccaattttgggggacagtcccaacttctctcaccgtgaaatggccttcccccaactcatggtggtcacattacagagacatattacagggctcccaagggccaggatttttttttttttttttggctatgtggctggtggggtcttagttccctgaccaggaactgagcctggggctttggcagtggcagcagggagtccttaccactgaaccactggggaattcccagaagtctgcatctcaagactagtgaagctggaccagcactagattatgggctggagtaacttctcctttcataatggaaactggaattttttctgaggtccactttgcagccaggatgaaataagggacagagatgcaaggcaacctcccacggattatgctgatggtagtgggtagggggagcatgacaggacccttcaggttgggcaaggatctgggacttagatgcagtgggggaaattcggaggtgcctcaacctgggagatgcaaatttataagtgatgccaaggagactctgagatagaatgactgggactctctactgttttgctttgatgttcagtgttattggagcctgtctgatgcatgggggctggactgaggctgatggaagaaagaaaatcaaggtgggggccttgattcaccataagggccaggggtctgaagaggttaggactcaggcgatctgaatggtggttccagagcctaaggcatttgggaggagcattcgtctgggtcagcctgtgagggacacggccgctgtgcattgtgggaagtggatgcttgtgaattcaaagtggggactaacacactctttgtcacagccccaaagtggcaacaacttaaatatccatcagcttatgagtggataaacaaactctggtctatccatgtaaggaaaacttttcagcaattaaaaaaagaagaactttcctagtggtccagtgggtaaaactctacaccttcagtgcaggggacacacgtttgatccctggtcaggggagatcccaagggctcatatattacaggatgtatgggccttgacaaccttgcgttaaatgaaagagactagtcacaggtcacgcgtatgattctctttgcatgaaatgtagcagctagggaaatccatggacagagtagagaggccaggggatgggaggaaaggggatgagaagggacgttggtggggggttcagaagatcaacttggggtccacacatcccccctgtgtgcttcaggggccatgccgtttacctcctgtggcgccatcatctctggggtctgtttatgcttcaagaccagctcttagttactgttgcttctttatagattgctgtttttattttatcttttgtctgtgctgggtcttcgtggctgcacgcggcctttccccagctgcgccgagcagggcctactctccatggcagtgtgcaggcttctcactgttgcagaccgcaggctctaggcatgtggacttccgtaagcacggcatgcagattctgtggccatggctcgtgggtggtagagcccatgtcccttgcacagcaaggcagcctcttcatcactgggctgccaggaaagccaagaccagcttcgtgagagagtctctgacacctggggatggtgaggagggtgagttcaggcaggcccagccagagtgaggacaacgcggcccacgtgctcttggcgtccttagtctcttttgctcaaatgtgggtttctggggcacagagctgctggtggccttgaggtttcaatttcctgtctcttgccaagcttctgtttgccatcctgttgtgtgagttagagcgagtcgtcacttcaggtgtgggaggctaagggttctcagttctgcccacaccttacagatgtctgggtctggctggccacacccagccttgtcccccaggtctgagtcaattgaggtgcatggtggggactcacacctttgactcttcagccaggaaaagaacccttgttctgcagaaaatattgcacaatagatcaaattgcacgcaggcaaaaacagaggggggaaaataaatattatagagatgtctccagcagttgattaatacaaatttggtgttattttctggggttttgtgatatccatgataattgattcctttttgagatttgtaacttgtgattttattttctcgttgtacacaaacattcacttttgcatctaattttgttttcttttcttaaagacggactcccaggattctatgagctttatgctcccaaacatttgggatctgcctcttatttgagggcttccctggtgtctcagctggtaaagaacctgcccgtaatgcaggagacctgggtttgatccctgggttgggaagatcacctggagaaggaaagggctacccaccccagaattctggcctggagaattccatgaactgtatagtccatgggggtgcaaagagtctttaactttcactaactttcttgtctaaaggtggccgttggtggtaaagaatctgcctgccagtgcaagagagggaagagacacgggttcaatccctgagtccggaagatcccctgaagtaggaagtggcaacccactccagtattcttgcctggaaaatctcatagacagaggagcctggcaggctatggtccatggggttgcaaagagtcaggcacaactgaagtgacttagcatgtatcttgtctaaatgttcatgtaggttcaagtttaacatttgggaaagagtatttcatacttatagtaaaagttaaagtcgctcagttgtgtccgactctttgcaacccatggactatacagtccatggaattctccaggccagaatactggagtgggtagcccttttcttcttcaggggatcttcccaacccagggatcaaacacaggtcttctgcattgcaagcagattctttaccagctgagctaccagggaagccctcatacttatacatcacatcagttctcccaggttgtctgtgtatctcaattcaagtgagcactcagttcaggcggtggcttgacagctagatctgtccactgtacaggtccattcgcccactgcagttactaagcagtcagtggagtcgtatgttgtcagtgtgcagatactgcactccctgacttaccactgcatggttttaacaaacattgatgagcctgtcctgaatcagttatatcactgggagtggcaataatgctaattatcagattccttcactcattctgcttttgttggctggaattctagaataaaggaagctttccttcattgatttcacagataattttaatgtcaaccaactatgatttggaagcaccgataaaatctattcatttatagatgagaaaaaccaaggttcgtggaggtataaagatttgctgaaaatcacacaagaactagcaatcaaaggctgtgtgtgtgtttttttttgataccaaaagaaaaatctttcccttgaaaaatttcgaaacaccagagtactgcatctcaagctgttgttcttttagaactcctgtcaacatttcccagaacagggcctggcttgcaaaatacaaccaggttttcagaaacattagaagcctttttgtttcatccaggagtgaaactggctccccactctctcacggccactgccccagcgtgggttcgtgcttcctaactcacttcatccgtgtcctactctttttgaccctatggatcgcagcccgccaggctcctctgtccatggggattctccaggcaagaagactggagtgggttgccatgctgtcctccagggcatcttcctgacccaatgatcgaacctgcgtctcttatgtctcctcattgacaggcggggtttttgttttttgttttttttaccactagcgccacctgggaagcctcgtcatgctctggaggttctggctaacaatgatcaaaactaaaaaagaagtataactgctagaaataagaatacaaaatcaccattatttgcgtacagtataataccttttctagaatacgatggttatttattatattagaaattaagactggggaaaaaaaaacttcaaaatattacttatcaggagttccctggctgtccagcagttaagactctgcttgccaacgcgggggacacaggttcaatccctggtccgggaaggtcccacctgaggcagagcaactaggcctatgagttgcacgtactgaagcccctgggcctagagcctgtgcttctcaacagcagaagccaccgcagtgagaagtcgacatgacatgagggagagcagcccctgctcaccgcaactagaggaaaacccgcactcagcaacaaggacccagcgcagccaaaagtaaatacatcaacaaaaattacttatcaagtcattcagaagtagaaaaaagccagttacatgtgaacgcaacaaatccttaggaaaaattattatattttcccaaacaaaaagcatttgctaagaaccgtgctactctttcatagcttcacagatctctttaacttctggacagtagcttctggtggacagtagctgggtcctatggcagctctgcacacagtaggtgggctgtcacacgtaacacagtcggtgggaaattccacttcacactcatgagagaatgaaagtgaaagatgcaaataacctcttggttattattttgaaaatagttttttttaaattaatttatttatttaaattggaggctaattactttacaatattgtagtggttttgccatacattgacatgaatcagccatgggtgtacatgtgtcccccatcctgaacccctctcctacctccctcccatcccatccctcagggtcatcccagggcaccagccctgagcaccctgtctcatgcatcgaacctggactggcgatctatctcacatatggtaatatacatgtttcaatgccattctcccaaatcatcccaccctccccttctctattttgaaaatagttttgactttgccgacctcctgaaagggtttctgaggctatactttgagagccactgttctggaacactcaggagactcagctcaaagttttactagcgtctgttagcttgccagagtgactggataaatgataaatgtttgtttgttcagtcgccaagtggtgtttgactctttgcaaccccatggactgctgcatgccaggcttccctgtccctcacccgagttcatgtccattgaatcagtggtagtgataaatatgtgaagacaagttactttcccatttaccagcatctctagaatgtcttaggcccacaccatgtgtgtgtgtgtatccactgtatcacctttatagaaaatctggaatctcagcaatccatggcgcatgatgctgggagttgaggcttttcagaggttcctttttcctagtctttccttctagggctcccagatggaattaaagggcagacaggatggtccccagctgtttccaggagacccatgacttcttatggttaaatctaaaagatgcttattagtctctttatcctaaagcagtggacattttcagggtcattcaaattgataacaaaaaagcttctttcctttgtaaacagaaaaaaagcttttttaaattattattttttgtgcctgtcagaattttgttcatggtactaattttcaagtatccccaaaactttattctaattatgttgaaatacgcagcgtctagttttgtctcagccctggaattctgttgttcagatgtttttcatgaaacagaaatgcttttacatgactaacagttcatttatgattcattattattttgagctataatttacataccataaaacatccattacagttcaataactcttcataattttatagaattcggcaaccaccaccacagtccaaaatatttgcttatttttgtttgactctttaaaatatcttaagtacaattagcattagagaaaatatggatgtctactttaaaacaaaaaaacccctgaaatttgaaagtattttaaagtagtgttttttccttcagtgactatgtcttaaactaagccaactgaactcattttaatgtcagtcaattattaaataatttattaaggacttccttggtgatccagtgggtaagaatccacttgccaatgcaggggacacaggtttgatccctggactgagaagattccacataccacgcacggggcaactgagagagaaagttacatgtgacaataagagaatccaccgcaatgagaagcccacgtaccacaactagagagaagccaacgagagaaagcctacatgcagtaatgaagatgcaccacagccaaaaatagatctggaaaaatttatcaagcatcacatcgttatcgagagctctgtgtgtggtgagtccagctgctcacagctcaaaggcccataaagaggccaggctggtggaaaggaaggtttgctttatttcagacgctggcaactgaggcagggggatgtctgtccagaggcccactcccccatcctgacaagcaggaggcgagagctcctatagacagagggggcagggggctacgtgcagaaacacacagtcgtctctagcagtcatctttaaatcggtcatcagtggtctcaccagcatcagcccgtttcaggtacagctaatcttcagttccagggtgcacttgtccccatttctttacgatgtgatcagttctcggaattgcggcagctcgtctcctgggtaccgtctggtcgtcacgtagttagcttccccacctggtgttttggtgtctgtaatacagctcccaggatgtggcgcagaatattatctgcagcccttgagagggaactaaaggtccttgactgcgcttaatgactacattttcatttagtcccctttgactatttttctttgattctgcagttctcatttctctgactaatcttattcgttgactaaggttttccacagacaagaggcaggcagagggcacggcggtgctggtgtgggggagggcaaggactgtaatggtccttgtcttctgctctgtttcaacttaatggctcattttgtgtgtcagcctggcttggctgcaccacccagatatttggtcactgttctagatgtttctgtgaaagtattttttagatgtgtcccagtcttttttttgtcatgaagacagtagttgtatgagattagggcctaccatattgactttactttacctcagtcacctcttcaaagaccatgtctccaaagacagtcattctgagctactgggtgttaccacttcaacgtcaacatttacaggggatgagaagaaacacagttaagcccacggaaggctagtctacttgactaacttcctttaaacttttaaaaattatttttcctcttgagacattcaattgaaaataagaatttcaaagtcagtttgggttgatatagcacagcaccacagcctggtggcttatagacagaaatttatctctcacggttttggaggctggaagtctgagatcaggcagggttgattttgggtggaagcccttctccgggtagcagattggtgacttcctcttttgtcctcactctgatgagagcaaagaggggaagtgagctctctgacgaccgttataggggcaccgatcccactcatgagagctccacccttgagactacatctaatcttaataacctccccaaagctccacctcctaatagcactgtggcaggtagggtttcaacagatgagttttcaggagacataaacactccagtccacaacacccaattttaattttcaatcctctgagctcattaagggtttaacttaacattcttgtcaaagcaatgatgtctggagaatgacagcagccttagctgtttgtgtttgctcaagttttcaaaagtgtagagtaaatcgcaatctgtaaagaaggttgagctctgcctgatttcccctcctacaagtcacttcaggttaagtcaacaaatagggcttaactctttcagctttccttaacacttggtgaataaatcatttatctgttcattcatcatttagattcttgaccgtctactgtgtagatgtgccgggtactctctaatctcttttgcagtgatcaagattaaaagaagaaaacaaaaagcacaaaagttctccccaactagagctcacattctagtgggagagacagaaaatattcaagagataaaagatgcttttttttttcctaaagagagaaaataagtcatggaagggacttaggaaatatgtggtatgtgtgtgtgtgtgtgcagggtcagggggggtgcaatttaaggagagggagcagaacaggccaccctgaaaaactaacactgaagtcaaaacttgaaatcaacatatgagtcatggggtcaagcatggtagaagagcagaactagggagagaagttggtaagtgcaaaggccccgaggcaggggcaggcttgctgtgcctgaggagcagcaggaggctgaggtggctggagcggagggtcaagggggaggtgatgtcagaatgctgatgaagtgccctggaggtcactgaaggcttggaggttttactgtaagaaggaagccacgggagggcgtggggtcaatgagcagtgtgattggcttacaatgctgaatagttacctaaaatgatggaagacgggcaagggctgaggaggaaggaagatcagccaggaaacaatgcaatcactttccaggagatgatggtggctaagatgaggtggtaatcgaagagtgtgtgaaagtagtcagatttgagatgttttagtggaatctcccagcagatagaatgtaagccaggagtcaaaagcagcacaaattctttggcctcgaaaaatgggagaaaggagttgctatttattgtgatggagaagcctgagggggcgggaaggttgatttggtttcaagtcagcatcagcatctcttatttcataacagacgacttttgaaaaaaagatactgtatttgaggcacacaattctagaatcttctagatattctgcaaccataaattgtctgaagaaccacacatgcatcactgcttagctcaataactgcttatcttagctcatccatgtgacatggtgcgacttgccaaattttggttcattgctgtatgatgtattttgttgtgctgtaattaatggtcactcatgcttagcaagcacttcttgggcttcaggcagaggtttacccaagtttatctaattggttgttggcagacctgggacctgtttcctggaccttgaagcgcctgcccctctgacacagattggtgcctaattgcaaaactgaatatcgtgccccatcagaaagaagggcttgaaaacattctgaattatccatcctcgtgctcgagaacagtgaactcagtaggttatttgttcttgcggcagttgagtttttgctcaagtcccacccttgaaaaagatgagcttccctgcattagaggaagtgtaactagataactgcaagcttagtcaaggggaaatttttgaaataaaagacagtacacatttgaggaagtgggttaacatgccaacaagaagtcaagaggcctgggcaagaggccaacaaagaatcagagaaatccacacttctccatgataattgttgaagactggacaatgcagaagcagtaaacatcctgaacttgtaagcagtcagagctgatgatccttaatgaagagaccggcatggtgtgtaatacaatacacgatcaaggtttgtagggtgaatgagtgctctcggccttcttcttcttcttctttttttttttccaacttcctttccctgaaatgacagacagcaacggaactaggaagacccaggcttcagttgacttatttactgttgatggttatcaaatgtgaactacaggaagcagataccagctggtacaggcccaagtacggaagaaagcttttgggtacaacctcagtatagtttctgaggaaaacatatatgcaagacaaatgtttcattttgccaaatcttttcttaaaaaaaaaacaaaaactacatgcatctattattttccctatggttatgattttaataaaatcaaatgaacagttctcattctgggtaaatatgtattcaaatcccataagtcagtggtcatttaagatgaattctcccagttcctagggctgcaggtttgttagccacaccatgtaggcacagcaaggtgctctgctcaacgcgccataaggcaggaaaatcagagtgttgactggactgaatgcttgtctggaggctctgcggaaaaaaccctccttgaaggttgttcttgttggccgaattccatcccttgaggtataggactgaggacttgcaccttatttccatgctgaatgtgagccagtgactacaggccacctgaattcccagccatgaggctcccaccctttagcagcagtgtgtcaaatctcaatgcttcaaacttctgacttcctcttctgtgatgaaccagagaaaaggctcagcttttaaagggttcctaagtcacgcccatcaggataatcttcctctcccaaagtcagctgtgttctatactctaacttgttaatcacgagcgtaaaacccattatactcacagccctggggatcatgcaggatgtttataccaggtgtggggatcttgagcaccctctttgaattccgccaaagttgtttcctcttgtagaatcagctccccaagatgaaggttagctagcttattgctgttgttcagttgatcagtcgtgtccgattctttgtgaccccatggactgcagcacaccaggcttccctgtccctccctatctccgggagtttgctcaaactcatgttcgttgagaatcagtgatgctatctaaccatctcattcactgctgccctcttctcctttgccttcagtctttcccagaatcaaggtcttttccagtgagtcagctcttcgcatcaggtggtattgggtaagcttcagcttcagtccttccagtgaatattcagggttgatttcctttaggattgactggtttgatttccttgctgtctgagggactctcaagaacttctccagtaccacaaattaaaagcatcaattctttggctctcagccttctttatggttcaattcacaactgtacatgactacaggaaaaaccatagctttgactatatggacctttgttggcaaagagatgtctttgttttttaatatgctgtctaggagctttccttccaaggggcaagcatgttttaatttcatggctgtaatcaccatccacagagattttggagcccaagaaaacaaaatctgtcactacttctaccttttccccttctatttgccaagaagtaatgggactggtaattaacttatatgcagagtacatcatgagaaacgcacaagctggaatcaagattggtgggagaaatatcaataacctcagctattcagatgataccacccttatggtagaaaatgaagaagaactaaagagcctcttgatgaaagtgaaagaggagagtgaagaagttggcttaaaaagctcaacattcagaaaactaagatcatggcatccagtcccatcacttcatggcaaatagatggggaaacagtggaaatagtggctgactttattttggggggctccaaaatcactgcagatggtgactgcagacatgaaattaaaagacgcttattccttggaaggaaagttatgaccaacctagatagcatattgaaaagcagagacattactttgccaacaaagttccatctagtcaaggctatggtttttccagtggtcgtgtgcggatgtgagagttggactataaagaaagctgagcaccgaagaattgatgctttcgaactgtggtgttggagaagactcttgagagtcccttggattgcaaggagatccaaccagtccattctgaaggaaatcagtcctgaatattcatcggaaggactggtgctaaagctgaaacttccaacactttggccacctgatgcgaagagctgactcattggaaaagaccctgatgctgggaaagattaaaggctggagaagtagggaacaacagaggatgagatggttggatggcatcactgactcaatggacaggagtttgagtaaactccgggagttggtgatggacagggaggcctggtgtgctgcagtccatggggtcgcagagagtcagacacgactgagtgactgaactgaactgactgaagaggactggatgcgatgatctttgttttttgaatgttgagttttaagccagttttttcactctcctctttcaccttcaccaagaggctctttagttcttcttcattttctgctataagggtggtatcgtttgcatatctgaaattgttgatatttctcctggcaatcttgactccagattatgattcatccagcccggcattttgcatgatgtactctgtggaggacaggaaagcctggtgtgctgcagtccatggggtcgcaaagagttggacctgagtttacgactgaatgccaacaacaacactgcatatacgttaaatacacaaggagacaatatacaaccttgtcatactcctttcccaatttggaaccagtctgttgttccatataagattctaactgttgcttcttgacctgcatacaggtttctcaggagacaggtcaggtggtctggtattcccatctcttgaagaattttccacaattttttctgattcacacagtcaacggctgtcccatagtcagtgaagcagaagtagatgcttttctggaattctcttgctttttcaatgatacaacgaatgttggtaatttgatctctggttcctctgccttttctaaacataacatgtacatctggaagttctcagttcacatactgttgaagactaacttgaaggattttgagcataaccttactagcatgtgaaatgagtgcaatatctggtagtctgaacattctttgacgctgcccttttttgggattggaatgaaaacttatattttccagtcctgtggccactgctgagttttccaaatttgctgtcatattgagtgcagcactttaaccccatcatctttcaaaatttgaaatagctcagatgaattccatcacctccagtagctttgtttgtagtgatgcttcctaaggctcacttgacttcacactccaggatgtttagcttaggtgagtgaccacaccatcgtggttatccaggtcattaagaccttttttgtacagttcttctgtatattcttgccacctctttttaatttcttctgcttctattaggtccacaccatttctctcctttattttgcccatctttgcatgaaattttcccttgatatttccaattttctagaagagaaaatttttcccattctattgcttttttgcattgttcattgaagaaggccttcttatctcttcttgctattctctgaaagtctgcattcagttgggtatatctttccctttctcccttgctttttgattttgttctttctcagctatttgtaagccttcctcagacaactgctttgccttcttgcatttcttttccttggagatggttttgatcaccacctcctgtataatgttatgaacctccatccgtagttcttcaggcactctgtctatcagatctaatcccttgaatctattcatcacttccactgtataatcataagggatttgatttagatcatacctgaatggtctagtggtttctcctactttcctcaatttaagtctaaattttgcaataaggagctgatgatctcagccacagtcagctcctggtcttatttttgctgactatatagtttctctgtcttcagctgcaaagaatataatcagtctgagtctggtgttgaccatctggtgatgtccatgtgtagagttgtctcttgtgttgttggaagagggtgtttgctatggccaatgtgttctcttgataaaactctgttagcctttgccctgtttcattttatactccaaggtcaaacttgcctgttactccaggtgtctcttgacttcctacttttgcattccagtcccctgtgatgaaaaggacatctttttttggtgttagttccagaaggtcttgtaggtcatcatagaatcattcaacttcagcttctttggcattagttgttggggcatagacttggatcactgtgatattgaatgatttgcctcggaaatgaaccaagctcattctgtcatttctgagatctcacccaagtactgcattttttgttgactatgagggctactccatttcttctaagagattcttgcccacagtagtagatgcaatggtcttcttaattaaattcacccataccaggccattttagctcactgattcttaaaatgttgatgttcactcttgccatttcctgcttgaccatgtccaatttatcttgattcatggacctaacattcctggttcctgtgcaatactgttctttacagcatcagacttgacttacatcaccagacacatccacagtcaggtgtcatttccgcttcattctttctggagttgttagtaatcaccctctgctcttccccagtagcatattgtacaccttctgaccctggggcttgtcttctggtgtcatatctttttgctttttcctactgttcatggggtttttgcaggaaggatactggagtggtatactacatgacttcatcagtaaacatttcagtcttatttcatctacaaacatttcagcatgtctttgaaatactagaaaccatgatctcatgatctcatccaaaatacattaataattcatattataagaatgcagttagtgctaatttttaaaaaccacgattatcgtcattattttaaaaaatgtttttaaaaacctgctctctagctgtggtgtgggggcttctcattgtagtggcttctcttgttgcagagtcctggctctagggccagcaggcttcagtagttccagcgtgcagggtcagtcatcatggctcacaggcttagttgtggcatgtggggtcttcccagaccagggattgaaccggtgtcccttgcattgcatggcggattcttaaccaccagaatcccagggaagcccccagtttttaaattgtcttataaatgtcatgactccctcctcctctccccctatttctctcaagtttgcttgtttaaatcaaaattgagactagatgaactctctcttttctgatgaacttgatttttaatgaaactagaccatttgtctcggagacttgctcagagtctggagctcgataactgcatcggtatggaggacttttctttgtcccccgtacttcctgtaagttggtaattggctccaaggcttgatcaggtcaggatttcttttttggggtagactaccctgtcaggaggcgcaccctatgttaatatgttttctttatccatccactcgtcattggacgtttgggttgcttccatgtcttagctgttgtaacaaatgctgtgatgaacatggatgtgctattctcgctccaagatcatgccttcagttcttttggatatatacacagaagtgggattattggatcatatgttaggtctggttttaattttctgaggaacatctgcatgatttccatagcaactgcaccattcacattcccaacaatagtgcacagagttccagtttctccacattctcaccaatgtttttctgttttgttttgatgacggtcatcctaatggctgtgaggtgatatcacgttgtggttctgacttgcatttccctgagcactggtgacgctgtgcatctttcatgtgcttatggtcattcctacatctttgtttgagaagtatctcatcctttgtccattgctaagtatttttttgttgttgtttttgagttgtaggggttcttacatgttctggacactcaccccttaacagatatgtgatttgcaaatattttctttccgtgggttgccttccactccgttgattttttcccctttgatatgcagccattttcgagttgtatgtcacctgcgttgtctatttttcttttggttgcttgtgcttttggtgtcatatccaaaaaataacactgacaaaatcggtgtcataaagctcttctcttatgttttcttcttggagttttacagttaggtcttacgattaggccttttatatattttgagttaatagatggtataaggtaagtgtccaacttcatttttttgcttgtggatataaagttttcccaatatatatattttttttttcaaaaggctgtcctttccccattggtggtcttggtacccttctcaaagtttattggaggaccagtttagttcagttcagttgctcagttatgtctgactgtttgcaaccccatggactgcagcatgccaggcctccctgtccatcaccaactcctgagtcggtgatgccattcaaccatttcatccttgttgtcctcttctcctcctgccttcaatctttcccagcatcagggtcttttccaatgagtcggttctttgaatcaggtggcccaagtattggaggatatgtaccatcaaaatttttagtgagttcagtttacaaagaatgaaggagtgataccagactctgtctgcacgttgtactctatgctcaaactcaaactggtaccactgtggtctggcctctccctggaggtgggggatagggcaggagaagctaccgtgttggttatctgtcttgggtaatggctcggatagttctgtaccactccatcctcagtagcttgttcaaaaggtgaaagagatgagtcagaggcaactcagccaggaggggtgcaggaggggccaaggcgtctcctttcaagtccaactcagctctgaagcagggtctacttcttcccatcctccccaagggtatttctacagatgtggggtttccttctgaatgattcatttactgcaaagtcctagttgttaaaagacaaaggtggttgtagtagaggaggtggtggctatggatctctactcatttgctttatcttgtttagcagaaccaataaccaaaccatttctgggtcaggtcacggtgaccaacacaagattcttactttttctttccttccctcattgtttaagaggagatatttacaaatagaagaacttcaagaagctccctgcataaccacactttgactgactatcctctgagggtaacaacacctaaggattcccatggagccctttggaaaggattatgcatgttcagtcgctaagtcatgtcccactctttgtgacttcatggactctagcccaccagtttcctctgtccatgggatttctcaggcaagaatattggagtggattgcatttctttctgcagggatcttcctgacccagggttcaaacccgagtttcctgcattcgcaggcagattctttaccactgagctacctctaagggctagaaaggattgaggcataccatttaagaaaagttttaagccagtgtttttcagcaggtaggatatactaactctctccagaaatttaagaatttgtttgcactttggtggtaatctttaaaaaaactaatacaagcatattctgaaatcatcagattgaacatcagaatgtgtttgtgtttagggtctccttaagatgtactgggcttccctggtggctcagatggtaaagaatcggcctgcaatgcaggagaccagggctccatcccggtctgggacaatcccctggagatgggaatggttacccactccagtatccctacctagagaattccatgggtggaggaacctggcaggctacagtccattagatataccagcactattctgataatttccagataatgggacctaaagagagacagacttaatatattctattccagccaaatgtgaaaatgaaagttgctcagtcatgtccgtgtctctttgagacctcctgacctatacagtccatggaattctctaggccagaatactgacgtggggagcctttcccttctccaggggatcttcctaactcagggattgaatccaggtctcctgcattgcaggtggactctttaccagctgagctaccagggaatccccagccaagtgtagtcaaattgtattaaccatgtattgcataaacagagagtcatcataatttgatcataaaaaagtaagtgctaaattggttagttacaactaataatacaggggagacaaaccatgctgaagtcagaagaaccttcatcctgatcagattcattctgtcagtggcaatttaatttcatcaaagtaacattattctaaatattgaattaatgcttttgcttcaatattatcatcttgtagttttgattgtgcctgcgctaagttgcttcagtcatgtctgactctgtgtgaccccatggactgtagccctccaggctcctctgtccatgtgatttttcaggcaagaatacaggagtgggttactatttcctcctccagaggatcttgacaacccagggatcgaacctacatctcttatgtctactgcattagctggcgggttctttaccactgtgccacctgggaagccctctggagttttgattagaagtcatttataaatttgatttagttttgtggttgtatgagagctacaaattgaagattatatttggttttattttttattttatgcattagtttttttactttttgactgcatggcgtgagggatcttagttccccaaccagtaccccttgcaggggaagtgcagagtcttaaccattggacctgccagggaagaccctacatttggttttaaattcacacatatttaaggaatgttataatttcaaaattgtcaattttgggagatgctgaagaatccagttatcatccagctttccacaaagaaaagctcaaatcaatgtggtttcactgctgaattttacaaaacatttaaaaaaattgacataattcttcataagctgttccaaaaaagtagaagagagggaaatctttcgtagctcattccatgagaccaaaacctgataccaaaactggacaatggcatcagaagaaagctacaaatcaatatcctttatgagtataaatgcaaaaatcctcagtggaatactagcaactgaattcagcaatatgtagaaaggattatacaccatgatcaagtgagagttactccagaactgcaggtaggtttaacgtacaaaaaccaaccaatgtgatgtgccatcttaatagtataagggggagaaatgatctcagtagacacagaaaaagcctgtgacaaaagtctaacacttgttcaagataaaaacagaaaagaaatgaggaatagaagggaacttcctcaatctaataaaggacatctacaacccacaccccagctaacatcttagttaatggtgcaagaccgaaagctttctcaccaagctcacgaacagcacactctttcgtttctattcaacattgtattagaggttctagttgaggcaatgaggcaagaaaaacaaataaaaggcatctggattagaaaggaagaagtaaaactgtctctatttacagatgacataatcttgtatatagattccttctaaggaattcaccatgaaaacaaaacacctgtatgagataataaattcagtgatattgcaggatacagggcattcccaggtcacgcagtggtaaagaactcgcttgccaatgcagcagatgcaagagacatgggtttgatccctgggttgggaagatcccctacagtaggaaatggcaaccctttccaattttcttgcctggaaaatttcatggacagaggagcggccatggggtcgcaaagagtcagacatgactgagtgactgagcacgcacacacacacagaggatacaagataaatgtaaaactaattttgtttcatactagcaatgaataatttgatatttaaattaagaaaataattccatttacttcaaagcatcaaaaagaataaaacaattaggaataaatgtaactaaagaagtaccaggctatcatactgaaaactaaaagagattgaaagaaattaaaagaaaactaaacagaaagctacccgtattcatggattggaagacttaatgttgtcagtgtggcactattcccctaacttggtctagagattcagttcagtttctgtcaaatctagctggttcttttgtagaaattgaaaagctgctcctaaaatttattctttgtcgtcctgtgctttgtaggatagttagcagcatctctagcctctaccttggagtcctttgacctgtactcttgagagtctgttggacagctaggagatcaaaccagtccaccctaaaggaagtcaaccctgaacattcactggaaggactgaagcggaagctgaagctctgatcctttggctacctgatgcgaagagctgacatattggaaaagaccctgatgttgggaacgactaaaggcaagagaagaagcggggtgacagagaatgagatggttggatggcatcaccgactcaatggacatgagtctgagtagactcagggaaggagtgatggacagggaggcctagcgtgctgcagtccacggggtcacaaagcatcaggcatgactgagcgactgaacagcaactggtttctacttgcttgatgccaattctcatcaactcttgggtaaaatgggctttggaaactagagatttggaatttccctcaggcttggaagcattatatgccaaggaggtgtggggaggcaccagcagcatctgctacagttaacccctatagcactcagatgggcttcccaggtagcactagcagtaaaggatctgcttggcagagcaggagacacgaaaaacaagggtttgatccctcgatcgggaaggtcccctggagaaggaagtggcaacccactccagtatttttgcctgaaaaactccatggacggaggagcctggcagggtacagtccatggggttgtgaagagtcagacatgactgagcacacacacagcactcagaaccatttctgtcctacattaactcacttcatgctgtactggttcttccaggtgatggctgctcacgattgaaaaagaatttaaaaaatcatcatgagagagaggttagggggacagctatatttcctgtttcttaagatggtcttaaggccatattagacattcatcttctccctcctcttccacccatttgagattctcctcactcttggtgagcaatttttttctttttggccacaacatgtgacctgcggaacttccatgactggggatggaatctgttccccctgcaatagaaggacaggaattgtagcctccagagttattttaactcgaccaccagggcagccctcatctagcacttctggtctgaactgctcacctgggggggtgacccagactgtacccccataactggggccttaccaggctgtcatggtaattatccactcccagtcatgacttgacatgaaagcatgaagacacgccccagggaattccctgtgttctgcaaacactccttcttacctcattatgtagacgtgactgtatctcctcagaataattggagatgaattactctggcctacagcacttcccttttctgtcttctggtttattggcacgttgcttagttgccaagctgtatccgactcttttgaaaccccacggactgtagcccaccaggctcctctgtccatgggattccccaggcgagaatactgtagtgtgttgccatttccttctccaggggatcttcccaactcagggactgaacccaagtctcctgcatcacaggtggactttattgctgagccaccagggaagcccctattggcatgaggagctcagaataaccaggttttagccacacagtggagttctatatccttttgcagaacacctccttatcccccatcaggagattgagacttctagtccagccaaacctgaagcgcagattcctcagggagaccctgggagtggtgatgagagatgccactagacatccatcccttggttcccagaactttggggattctaccaattggaatccagcacccccatccctcaggattcgcctaccaacgggtgccttcattgtgccatttcaggccatcacaatgtttaatcaaactggtaactttcaggtgatgttctacacagcaggatcactggatcccattatcacatgcccattttgacataaaatggagcccttggtttgcggcatgtatcacgattcaatcagagaagcagagccattgtgagtgacatagtgacctaggtattctttttttgccatgttatgtggcatttgggaccatagttccccgcccatggatcaaactcatacccccagcatggaagcgcagtcttaactgctggactgccagggaagtccctcaaaagttttttttataaaatttcataatcatctctttccataggtaaaatgccagagtattcaaagcattgtgtagcaacaaaacatttttagtaatgtcccatgcactatttgaaacacacttatactaaacaattattcactgtttatgaattattcattattcactgaaatgaaaactcagtttcactgggtgtcctgtgtttttgttaaatgtagcaaccctaaacagtatacagtcttcagatacataccactttcttcacgtttcctcatgatacaaccatttaggaaccggttttgaaaataccagctagttgtgaacctaaagagggtgacttgtcttcccctagtggtgaatccagtcaagtggtaattcaaggtcgcacttaatcactttaactaaacacttactgtcagctgcaaagtgtgaaaaaaaaaaaaaaaaggtccttgcgtttatggagctcaccgcctagagaaggggatgtattctgggggatgctataaaatctctcctaaggcagtgtctctgacagacatgaaggggcaggtgggcacaaaagtgacttccatgtatgcacatcgtggaggtcttccaggaagacttcagactggatggtgcccctttattctgaaacactcagaatcatctttttttttttttttggctgctccaccacagcatgagggatcttagttccctgaccagggattgaacctgggcccacagctgtggaaagttcggagtcctaaccactggaccaccaggaaattctccatgtctttttaaaagttaaattccagaggattaaagcattataaaatctggatcagacagtggtacacaaaaagacactttgctattttatcatacatttaaggcctaaatccagtcttttggaaaaatggtccatctttctagtggagagataggaaaatgttttcttcttcttcagtcattcactttttcctctgctccttctgagggatccaggaaatttggggaagtaggaccgtggagggattggcaagtcactgtgaggagaaaaagtttattgagtaacttttttggggctatgccacgcaggatctttcccaaccagggattgaacccctgccccctgcacagggagcttggagtcttaaccactggaccaccagggaagactaagaaatgtttaatttaaaagtgctactgagagacctaatttttccattttctccctcttcccaagacctttttctaagccactgagagacctaattttccattttctccctcttcctaagacctttttctaagccagaatatcgactctgcccactctttcttttcatggttggtcaactaccatgagctgttgacatgagctaccatgcagaagaaaaaaaaactggatgttaccagtatctgtcactagtgttaagtaacagggcgtctcttgtgcatcagagatgaaattattaacattcacttccctgtacattttgggaaagtatttgaggacgcttactaaaaacacatgagggttctcagcctgaatgtcaatggtgtttaacttcagatcaatttacatgtgggactgcggagtctccttcaagagcgtacctggagaagaaacgttggtcaaagggaacagcatgctttgagggggcagggtctgcattacaactgcagacccactggctcaaggctgtgtccggccaagtctaaacacaaggttgtgaaaataaagcaaagactgtgcgagagctccccgccggggtggccccttcaggacaccaacgctgggcgcggcccacccggcacgggaccagccccctctgttatgaacacctcacaaaggcagcagccaccgcacccgtgatgcttacgttcaatcaaaaccaccatggaacccaagacttttggcctcagtgtttattacagaaactgttacaaatgtttaaaaaacaatggcagtgggcattaagacaaagtacccacgaaataagacacaaacactggcaacactcgctgtgttttcatagaaacactggaaatatggccgtgtcctctgcctcaataagacagacaaacggaaacacccacttggttcaaattctaggtttccctcacttgacaattatttcctatgcaattcttccgcgtgagcaccgcaccctggtaggtactggggatacagtgctaagtgtatattcctgagctcacagagcttctggtcccctgcgaggggcagacagacaccagctgaaacaaacacaaacgtgtcaggtagtccaagggttacagggatggggaggaggtaggaaaagctggacacttccaaattcttagaagcaatctgaggctgctttgaaggtaggtttggggaaaagatgttatacaaactatatatatatatatatatatacacatatacacttaaaaaatttattggacagtgccgagtcttagtcgtggcatgtagaatctagtttccctgaacagggatcaaacccagggcccctgcattgggagctcagagtcttagccactggaccaccaagaagtccctaaatatatagaaataactttatatgttgcaaatttctggtcaagatttagaagctcatagttctagagcagcatttacccttttctaactagaacctatgctaagtgtttatggatgtactagtggcacagtcgaaggcgatggcacccactccagtactcttgcctggaaaatcccatggatggaggagcctggtgggctgcagtccatggggtcgctaagagttggacacgactgagcaacttcactttcacttttcactttcctgcattggagaaggaaatggcaacccactccagtgttcttgcctggagaatcccagggatgggggagcctggtgggttgccgtctatggggtcgcagagttggacacgactgaagtgacttagcaggagcagcagcagtggcacagtagccagcatcatatgtgaacatgtatgtttacagacccatgtcactatgtatatattaatctacattacatatgaatacctgatttctggctgcaatgacacaaatcttctacataaatgcttacattatatccagcctctccaagagttatcagtatcacagatttgaggaagtttattgctgctctcaagtatatagtgtttgcaagcaaactattttttcagaaaaaatacttaccatcttacaagtaagcacatcttcattaagctacatgtggaccacaatgaagaatgggatggaactgcattttcaggtctgcaagatgcggcaaaacggaggggtttttgttcgaggccgctcagatgcttgtttattgaaaaccacaggggatcttaaaccccagacacacatactcctacatccagggacctagcgactttagcagcatctctgccttataatgccctagttttccctctgccacgtcccacaaaggcactgttcccagtccgaagcagtgtttttcctgtggaaaatcccaggcccgactgcagggcaggccggccgccttgacccagcgcggaagccggcgggggcagggtcctctcgacagtgacaagttcccaaggacggacggggcctttcccagcgaagggcgagtcctgatctgctttaaaccaaatgcctctggtcagaggatctgaggtgcgtttgggactctggaaggattctgcagcagagaaacgccctggttggggcctcctgaccatgcactccctgaggagctggatggaggcccagcggagcccaaggtgctctggagaggacaggcggggcgccacagcccttctcagcgcagctgctttcaacctcttcttccacccagaagaccctgcggaccagtctaaatgagcccagccagacctgatgtgctgggtggtgccatctctctttcctcagtcctgctgcaacgactgaagctgagaacttggcctcagaggtagccagaattcctacacttcctttctctgcaggaactccatgaataagcccaaacagcaaaatcatttaaacataaattatagatgcctttgagaggttttacataattttaaaaactcaggtttccttcctagttcatttcctcccacactctgatgataaataacttgcatttccttgagtgcatgcaggctgagcggaagcgatacctgcatgcctgtgaatattgccccacagtggacagaagccggccagcttatgttaagaagtgacacagatgagccgtgaaaacaaatgccacccctcaggatgttagtaatcagaagctgacgatgcacattattcttatttttcactaaagctacctgcttctttcccactgactcacactacttactgtttctcagtagcattttctgatcccaagactttacatacactgccactaacgttccacactcccatatcctaagagataacagtaacttctctactcagcctgttccccatttctctgtaattttagggattatgccttctaatcagaagctagtgtcctaatgttctgaaacaggaagccttaatgtacatatagtaaaagatgacatggttttaattctaaactgtagaagggatgggtaactgtgatgcagaggccaatgtaattggtacgcgtgtatgcacgttcagtcgcttcagtgtccgactctctgtgacctcgtggactgtagcccgccaggcttctccgcctatgggattttccaggcatgaatactggagtgagttgccatgccctcctctagaggatcttcccgacccaaggactgaacccacatttcttgcaactggtataaatgtgattggtataaacagagagaatccccctgaaaaatctataagaacctcgtttctggcatctgcagctgttttccagagtaagctactttttcagaaaatcaagtgatggtggtattcaggttcttctttgaagaagaccaaatgttctgaatatctcctgaaaaatagtgaactataatgctgtgggggagagggagcagcgcagcgttacacagcgacagcaccagctgatgggaacacaagcacccccaaaccccacgccagcacagggctgcttacagtagcgtgagggagacagagggtatcttctggacttaacgcctctcatccaaggcaggtccaatgacaggcctttcaagacttgacacgtggcaaaggacgcagaaaacttcttgaaattcattttaaatagtgaagtgcttgcctgtattttttggacctgcgatctgaagacgctttttcttccccgacacggacaatcttcttttgacagttactgagaagagcaaaaagcccaggctcccactctgactcttgcaagactccctaatgtttcagggtcattcctggtcacacactgtcctgttgcggaaactcttcgcttattttgcttccactgttttcatcttcgtttgaatagtttcctgaatcttgactagtttgggaactgtactttttgtgaacttcatcaatttcatcagtctcttctatttcagtaataatgcttgcattttcaattataaaacatctttccgtttgttcctcagaagtggaaaggagtagattccttagtggctgatcggagaaatactaattcaaaagggaaagaacagaaacagattatttaaaagaacaaaaagtggttttcgagttccaataagcttcagtttcttaaatcctttatctagaaatcctatcttttgacacgcgtattaaaagcgagctaagagcatatccaccgcactatcgtgtttagaataaaggcaccaccagtgaggtcacgcacatctcagtactgttttggggaaattatccaaacagtctctaagaaagtccactgtgctacgaggggtcagggtggaagagcgtggtgggtaaggaaggaacgggagggcactgggatgggggacattttgttgtgaaataataaaatgctggtatccaatccgaaaacatccagaagaggcacaagggagagttaactttttcccagttccgctaagagtaacttgctagtcttaaagttctttaagtaacagctctgaatagaagagcacatagaaatgacactagaaaactcagggataagagggtgagacagctcacgtggacagagtgctggcgcagcggtgggtctttctggtcccccgccctcgctcctcacagttctacgggatggcactgctggcgctgctgtacagctatgggcacttgtgcaagtgctcatgactgagctgcacaagttcagagccagtcagtgcaaatacactacagcccgtcagtgagccaccttctggcctccagctccatggcctgagaacctgcagcaaggcaggcagcgtgggagccactccaggtgcagacgccaccccgggcagcgtccacgctgacggtcatcgctttgtgcttccacgaactgtgccaaccacacagacgtgccagccaaaacaccgaggtgctgcgagaggaaacgcgcctttctctgtctcattttcggtgatttcatccacagaataaagtttctgcgctggcgacaatgttttaacctttttgggaatatagatggtaaaacaagtgccccagcagccaaactgccagaaaaacacgggattaaggacacatccttctattccacgttactctgttacatggctgcttctgaagtcaattttctaaaactctgaagaaaaaaacccaggtccgtctgtattattttttgaatatcaggaacacatttatattctgttgcaatcaaatatatttccctttcattttcagaaaaatccagctagctgttgaccaagaaaagtaacctacctcgtcaacagaggaaggaggtttacttgatggaaagaacacatacttgacacatctcaagaagacgctcacaacataaatgaccacaggaatagaaaacaatgcagtgcaagttccaactataagccaggttttggaagtatttcctgaaaagaaataaatggtgtttagcatcaatataggttttgacacacaaatacattaagactgctgacagtttgtgtgaaagaaatacagccatgtgaaaggaaatttacattgttaaataataccaataacataaaaaattcacaactaagggatttccacatgataattatatcaaaggttatataaaaatagcagtctcattaaattctaagagtaatgcaagaaattaattatgtggctatgcatgaaatataaagcatgcagaaaccactgaactaagttgagtattaaaaatattttctaaaactcagtgtgaagttttgtgaaggtgtgaaggtctgattttgacttacatagtccattaagaaaatattctctatattttcgcagcaaaacacaaacattttacagttttcaatgaattggttatttttttaattaaatctagcaacattaaaaaagaaaaagtataataaaagatcctgacctggttttgttttctcacacacagtatcactaaaactgctccctttattccgcctgtcattttcaatgagtgctctggctttgacacaatacacagtcagcggtttcaagtcaggaaagataaaattggttcttttctctagaacttttctctataaaaaaaataagtaaatcatcgataaaatttagaaccccaagaaatcatagagggaatatctgttttctgaattccttaaatattcattctaagattaacctcttccaaacacttggttggtatattttaagaaatataaatttattttggacaatacgccattaccaaactcaaaagtgaaacatgctcctgccaaaagaataccataagacaacttgaagttattttatcagtacatatcgacttggctgaattaccacgtgttacctctggttagaggcagaacaattaagtgcggggcgcgggggtggggaggttctggtctcaaactgcctgtatcaagatgttacttatagctatgtagccttaggcaagttatttaatttcctgggccctattcccagatctataaagtgaggacaattactactcctatttgtattaatcagctagctattgctattgttttgttactgtggtgtaacaaaacacagcaagtacagcaaaataacactgtgcaactctgtgtaacaaaacagctgtggctcaaaacatatttttcttttttaaaaagatttaaactttttattttgtattggggtatagccaattaacagtgctgtgagagtttcaggtggacagcaaagggactcagccatgcatatacatgtatacagacgtatttgtttttgttactcatgagcagatcatgcgctgatcggcccggggagctctctctgaggccgtggaccacgttcaggtgtgctctacagcctctcatccgccttggccgacagaccatgtggagcttgcttcagttcagttcggttcagttcagtcgctcagtcgtgtccgactctttgcaaccccatgaatcccagctcgccaggcctccctgtccatcaccaactcccggagttcactcaaactcacgtccatcgaatcggtgatgccatccagccatctcatcctctgttgtccccttctctgcctgctcccagtccctcccagcatcagggtcttttccagtgagtcagctcttcgcatgaggtggccaaagtattggagtttcagctttagcatcattccttccaaagaacacccagggctgatctcctttagaatggactggttggatctccttgcagtccaagggactttcaagagtcttctccaacaccacagttcaaaagcatcaattcttcggtgctcagctttcttcacagtccaactctcacatccatacatgaccactggaaaaaccattgccttgactagacggacctttgttggcaaagtaatgtctgcttttcaatatgctatctaggttggtcataactttccttccaaggagtaagcgtcttttaatttcatggctgcaatcaccatctgcagtgattttggagccccccaaaataaagtctgacactgtttccccagctatttcccatgaagtgatgggaccagatgccatgatcttcgttttctgaatgttgagctttaagccaactttttcactctcctctttaactttcattaagaggctttttagttcctcttcactttctgccataaaggtggtgtcatctgcatatcagaggttattgatatttctcccagcaatcttgattccagcttgtgcttcttctagcccagcgtttctcatgatgtactctgcatagaagttaaataagcagggtgacaatatacagccttgacgtactccttttcctatttggaaccagtctgttgttccatgtccagttctaattgttgcttcctgacttgcatataggtttctcaagaggcaggtcaggtggtctggtattcccatctctttcagaatttcccacagtttattgttatccacacagacaaaggctttggcatagtcaataaagcagaaatagatgtttttctggaactctcttgctttttccatgatccagtggatgttggcaatttgatctctggttcctctgccttttctaaaaccagtttgaacatctggaagttcatggttcacgtgttgctgaagcctggcttggagaattttgagcattactttactagcgtgtgagatgagtgcaattgtgcagtagtttgagcattctttggagcttgctttcctcttggcaaatgtgagaagtgcaagagccaagccaaaccccacaggcgcacttagggcctcagtcataccacatccactcatgtttcactgcctacggcccagcatcagcgaagcagtaatggatactccatcctaagtatttgctgaagagtaatttaatcgatccaactgtctggcagggttgtttggaagaccgattgagacaattcatgtaaaatacttagccccggcaccccatacataatgagtatccaataaatatgagctgttattatgactgcaattactgacgtatgagctgttattatgactgtaattactgacgtcttacccagcataagacaggatggcaaacaaaggttattgaatctctatttgtcaagcaatgcggtaggtatttccataaatactacctcattttaaaccttaaaaaaatctgtttaaaaaaaaattaagttgctatgacccctgccactttagagaagaggaaacgagtttcagtggataagcagcttgcctaagcttacaccatttggtagtctgagacacaaatttaggttttccagatctagggaggacttagaaccacgatactcaacaaggctaaactgtgcagagttttcagatagttaaaatcaaagtatccaaatcactggacttttcttagattttcaacagaaaatgaagttacaaaattcaccaacttaactgtaccagatttttaaaggctgattccctgatggtaattccacagggaaaagtgatctaggaataatgtggattatctgatgtgcattagcctgtcagtggtttctgaattttagggtctgacaaagcataataacagctaagagtcttttgtcccctaaaagccagtctttgtcctcgtggaggtgcctcaatgtctggcactgcagggaggtggtctgggttgtcacacctgggagggagggctaccagcacctagtgaggagtggggagggcattactagccctcctataatgcacaaggcagctcctgcaactgaccgaaaacccaaatgtcagcagtgttgagaaactctggttcatgaatccctgagggtcatgataaaaactcctgagctctaccctcagaggttctgactgagtacaaatgaactcaggatctgaggtttagaaactagctgggggcactttcctggtggtccagtggttaggacttcatgcttccacggcagggcaggcgagttcccttccctgatcagggaactaaggttctgcatgccacttggcgaggccaagaaactcccccaaaccaacagcaactaactgggacccagatgcagatgaccgtaactcttaccaagtaaaacatgaaatgccaatttcttcctacggaaaatatctgagttaatcatatagcctaaaagtttaaaaatttccctgcaattttaacttcaagctttgcttacccaaatcatagtcataactctaagttataaacctatactacacagtctttttacctcagcatttgaagtgttttcccaaaaaattacttcataaattagcgggtagagctgattcacagacatgttttcagactcttctgaagcaccaacactgacatgcagtgaatcatcagtaacggatttcacgctgatgactggaggaaatatgatagctaggggaaaaaaatgtgtaaagacacaaagttcaaatcagactacaaaacaactgtaagaattcataattggagaatcacaaagtaaaataaaaactactggcttacttttcatttcagtattaaattccttctcttcagaccaaaaagaggtaccatttccattagatgctcgtacacggacatagtaaattccccttgaggaaacctctcgaggaaagacacagtgggtacttgtgacattttcacagttcggtatttgtttccatttgtctgaatgattcccaggaatctttttaaaaaaggcactttaagacaaaaagatatttttcattctaaacacattagttcagtaaacatctactgagcacctgtaataggccagacattctgttagaggccgaagtcacagaggtaaactctactcagccttgggaaactcacaggacactggaagagatgtgttcacaaaagaaaaccaaagaccgtgctcaagcgtgcaataaggaagtagtgtgaagggttggctcatgccagtgcacaaaaacaactgctaaattttcaggaatgcaaccagctagctgttaaatgcagccactgttaaaagttacgtaaacttataaataaatatgttgtattaaaaactaaagtgataaaaatacaaaactcatcttctcctaattgttttccctacattttatctatgctcaatgctatttacatctatcgtgtctgaacagtggaatatggtggagggcttactgtgcctcttcccgactccatgtccagtggacagatacgctgctgggagcctcaaagtggccacagcaggattagctgtgttataaaacccggcaaacaccaaagtaaaacttttcccttctggaaggccagctgctagacgtgtaccagcatacccatgggtcagtgctaagacacacaccagggttctgagagtgagtctgaacagtcagagcgggtctggataggttaatggactgctctgagaccaacagctgcaagcctgtcagttcacgcccggaaccacggcagcctgcaagcgggctcccctgtcttcagtcccccgcaccacacaccatacggccatcgtcacgctcctcgaacacaggcctcatgttacccatcgctcaacaccagactcccagtggctcttgaatgcctgcagcagagtctaaggcgaagcctgactttactccatcctgttaactcaaggctccctctcgctgctctcccagacccagtgttctgctattctcgaagcaggttttcccctcttgtaggcaaaattccaaactggcccccaagattcctaccctctggtgcatgagccggacatcatcccctccccctgactgcgggcaggcagaatccatgaactcttgattaggttacattacttgaaaggtgaagggattttacaaatgaaatcaaagtcccaagccagtggactttgagttaatcacatgagaccctatcctggttgggcctgacctgatcagatgagcctttaaaggaaggtctatggggcagagattgtctctgttgacggcctctgaggcagcaggccaccatgcattctatagctgccagaaatggattctaccaaccaccacgtgagcttaggagacaccacgagacagtctggatgagacagcagacccggctgacaccctgaccgcagccttgtgagacctcaagcagaggaccccactaagccacacctgaattcctgacccgaagttactgagagataataaggcgtgttttttaagctgccgagtttgtgctagtttactacagagcaaagggaaatggatacctcctcgttaccctgatctgattttgtctcttcatatccaagctttccgatgtgtgtgtagccccagcctggaatgccatctctcgtcattgaaaaacctccttcacgaaacctctccttccaaatggcttctgcggactctccagtcctgtgctcacctctacatttctgacctctgcaacctttattgtctgtactccacacacgaatgcatttattatccagactgttgttgcttcaaaactaacaccgaagagtggagaggaatcaattgcagcagtatcgacttcccttctccctcaccttttctctgtctttctagtctctttcttccctacctgacctacactcgcctttggtcccgcagttcctctgccctcggtaactgtctttgtggcccccttttcccccagagttcacttcaccttccgcttgatgaccctcttctcttctccctctccgtttatcctctccagttttccaatcaatataaactacacccggtcctcttccactcctgtcgtgctgagctttgctcctgtctggctggtctctactcaagcacagagagcacagttctctccaacttcctcagtttcccactaatcactaaggaacctgccaaagccaccacaacaatcaagacagtaggaggactgacttgaactgaactagaccgagtgactggactgagataatttcaaagactcatggaaggagtgggttttgaagaaaatatcttggtcatctgtcaaatattccagactgaggaaatacacatgtaattagaattacaccttaaaaaaaaagccagtaagtccctggtggctcagacagtaaagaagctgcctgcaatgcaggagacgtgggctcatttcctgggttgggaagatccctggaagaagggaatggccacccactccagtatccttgcctggagaattccatggacagaggaggctggcgggctacagtctatggggtcacaaagaatcgggcgtgactgaacaactaacattactaagaatactagatattataatacacccatttcagaagtgaagaaactgaggccaaaagaagtgactgggtctcattgacactccagacggttattggcagagctgggactagaattaaacaccccagttccaatgcatcataaccacctttccatcaggccgaatgtgtgcaaagaacaacaggtggctgaagcagagtgaaaagaaacctaacacactgggcaaaaataaactgcaaaaggacatttatgggaaagaacttaccggagccactgagcttgaaaagttgcgttttcatatgggtaatcccacttaagaacatagatctggttgtcagcattgatttgtatattttctggtgaaggtactttatgtctctctagaagacaaggaacacacaagaaagcacacacatttactctagtgagagaacagatggcaagaattcttaacagcatgggcaagaagagaaaaggatagctaaataatggtgtgtattcacacaaggtaatactatacagccatttaaaagaatgtgatagatctatatgtattgacataaaaagagaacctcaatatattgggttaagcaagcaagtttaaaatatatctgacatgactttatttattttttaaaacttttaattttgtttggggtatagcagattaataatgctatgatagtttcaggtgaacagcaaagggacttagagatacatgcacatgtatttattctcccccaaactctcctcccatcaaggctgccacgtaacactgagcagagttccatgtgctatacagtaggtccttgttggttatccattttaaatacagaagagtgtacacagaactttattccttaatttaaaagataaaacaacccgaaactgtaagtctgagtatatgctaatataagccttgaggaaacgcagggaacactgtgtgcacactgctggggatgcttgtctctggtgaacagagtggggtcaggaagcaggagaggagatctttcctttaactcccttctacactgcttgattttaagaacaaagcatactaaatttataattaaaacaataaattcaagttcctacccttaaaccttaattgctggcaagatgccacagataaaatgtatcaggatgctttcataatttaacttttcacctataaacgtatgctttttggaatactaactgcttttctagtgactatctccccttctcatggattctgaacaagtaaaaacaatttctgtcattagaaaatacttggacttttacacagaattttcattactgtttacttgagacaaaaatcccaaataacattcttgcttgtgtaaatgctgttaaaatgtgtgcttttttttttaaaaggtatttctttttaattggaggataatagctttacaatattgctttggattctgcctacatcaacatgagaatgtttttgttttgatgtctactaaaccaacacaaaaaattcagcaactatgggaaaaatgccaaaattaaaaggttgccaattaattaatagattacaaggagatcaaaccagtcaatcctaaaggaaatcagccttgaatattcattggaaggactgttgctgaagctgaagctccaacactttggccacctgatgcaaagagctgactcactggaaaagaccctgatgctgggaaagattgaaggcaaaaggtgaagagggcagcagaggacgagatggttggatagagtcaccaactcaatggacatgaatttgagcaaacttagggaggtagtggaggacagaggagcttggtgggctatagtccatgtggttgcaaagagtcagacacaacttagtaactgaacaacaacaaacaacttatatatatagttactgaattgaaagcaaaacttccttcttacctgtggtatttatacaatacactggactatagcaaccaactctactttgtaaacgcagttctgctttaacttttaaacaataagtaatctctggtgacagtttataaattttatcttcgggataaacagtttccgttctttcctataatttaaaaaaagagaagtctgttctttaaaaaaagtcaaattttacaattaattcatgtcattcttctctcacatcaaacaaagataaaaacaatgcttacttctagacttgaagagtttttccagataacgacgctatacctaaagcttgaacgatccatagcccacatgatactatcttttgttccagggggagagatactcagtattattgccttatcttcagcttctaaatgcacatctgggggaccaatctgagctgtgaaaatcaaaacatttactatgtaagttcactaatacaagtcaaaacattcatacaataaataattctaagcacttaaatatgtgcctggcatctaaaaaaggagaaaatccctcatggagcttacactttactgagaaatgtggccaaaaatcccaaatatatatatatatatataatgttataatgtcatgcatgctgtaagaagaaatgaagcgatataaagggacagagaagggtggcaacgactgttttaggtgagtcagtgaggagaaggctccctgagatgtttgagctgaggcctgatcgaggtgaggtctgaatacggtgaggtcaagcaaggcaggctgagagcaccccatgggctccggaacgtgctcaccgttttcaagagacactagggggcactcgagtgcctgggtggtagaaaataagatgcgagatgcagctagactctggctaacaggcagaacttgtagtctgggactgtaaggtcgccagaacctgatttacatttgggaaagaccaccccaggtagcatgtcaggaagcaggaaagctcctgggcaggtgagagcagcagggagggctgacagccgggctggaagtgagaagcggtctgatcgctcggaatctgttgatggactggatggaagatgagagagaggtatcaaaggtgatgtcagggctcctgcctgagcaaataataggtgacgtcattaacagagatggaaaaaactgcaagaagagtgggtctggaggggggaaagctagaactctggccattttaaatttgagacgagggacttccctggggctggtggttgagaatccgccttccaaagcaggggacatgggtttgatccctggtccgggacaattctagacgccttggagcaaataagcgcgtgtgcggcaactactgaagcctgagcatctagagcctgtgctctgcaacgagagaagccactgcaatgaggagcccgagcactgcgactgaagagtacccccacctgcccatgagaggcaacgaagatccagcatggccagctataaataaataaaatttaaaaagagtttttgagatgactttcggacctctaagaggagatgctgactggagagctggtgacgcagctcgctgaggtaggagaaggatggcgctgggacgtaaactgaggagttgagagcacagagggtgttgaaagccttacgattcctggtggaggctgcactgagagaggaggttcaatggcggagccctgcagactgaggcccgctgccgtccaacattttaaggtctgggagacaagaagaaattggcaaaggagcaaccaaggagcaggaggagagcctggaaagcacagtgccctcgagaactgagagggaagggtttcagaagggagtgacactcactccctgggaatccacccggcactgtcgaggtcacggtgaccttggcaagtggttttagtgtagtgatggggaacaaagctccaacgcggagggctggagagggagtgggagggaaagtgtacatgtacagagaagggatacggatcatccttgtgtgagttatggaatagggtggtggttcttgaactttctggtcttgggatccgttacactcttaagagaaatcgagggtcctaaagagttcttgtttacatgggctgtgtctttcaatgttcagcatatcagatgtcaaaattgacaaaaatgtaaaatatctatcaattcattaaaaaacagtaatgatgaaacctattgtatgataaaacaatgtctgtattttccaaaacaaacaagccaaaaaacttagaagagcagtttgaacattttgttcaaatctctttaatgtctggcctaataaggaagacagctgtgtctcacacctacttctgcatcaccagtcagtcgccatctcacatcaaacagcctctagaaaactccagggtacacccacgacagaatgaagatgaaaaaggcaagtaagttttattaagtaagtttccattaggaaaatggttttgacttgatagatctcttggagaccacactctgagaaccaccactagaaggaaagcaggaaaatgaagtcatagcaggaaggagataccagtttaagggaatctttgttctttttgatttttttaaagatgggagattttatattatgcaaatgaatgggcttgggaagtgagctgtgctggtaatatttaataaagaattcaatataattcagctggcaactttttcttaccttctagaaatggtacaaatggctcaacctcataccatgtggaagtgttgtttccttcttctgctcttatgcgcaattcaattttttcaaaaacattttcaagctcgactgaagaaaagttgcatttggtactagtaatatgttgacacccagacaatttcttccagttatccgttcctagtcttcaagataaaaaagcaaaggaatgaatgaacattataaatacaagagtgacaaacatgttttctattgacattaacattataaagccagtgtgtgtgtgagtctctcagtcgtgtctgactctttcaatcccatggacggtagcccaccaggctcctctgtctgtgggattctccaggcaggaataagggagtgggttgccatttcctcctccaggagatcttcctgacccagggatggaacctacgtctactgtgtctcctgcactggcaggcgggttctttaccattggagccactagggaagcctctaagctaaggcaagtagttattccttctagtaactctacttcagttaatgttttgataatatttttgtgtgtaacattctactactctttttcattgcatacacagccaagttattatttatacagtggaatcattctaacatacagtcaacttaataaagttctgtaattctgtgggtggttgcattaggatttcaaagaagcagagaaagaacccctaagacgaaagaggacttagtgttggctttgttaaaaacagttgtgtcacttttggccaactgctttctattctggatcctctcttccccactgaaaatctgtaaagtggatttgattcccttctgatctcctcctaggaagagatttactagccctaagcaagacctcagaatcagtatggtttgagaacttcctctgctctccttaaaaccaaaccatcccttctgcatactgatctctgtaattccttctattacaccaccagaaacaaagaacttaacatgttaacataagctaacaaacttctccatgtggactcagtccatcatgaagcaagcttaagtgactgatactagacttttttttaaaagcacatgaagaaatcaagttgacacacggtgcctaaaacaaaaaggccatgctgccacaaagaggagaggctgaagtgaaggtgagcaacagaaaacaaatactagatttcaaaatgtttgcctctggaaagccctgtctgcctcatatcaaacagggaaactaacctctgagaagacatttttgttaagcctaatgcacagttctagcataagctcatgtttatatattatagacctcattttaaagatgctaaagtgtcttctggagaaggcaatggcaccccactccagtactcttgcctggaaaatcccatggacggaggagcctggtaggctgcagtccatggggttgctaagagtaggacacgactgaacgacttcactttcacttttcactttcatgcatcggagaaggaaatggcaacccactccagtgttcttgcctggagaatcccagggacggcggagcgtggtgggctgccgtctgtggggtcgaacagagtcggacatgactgaagcaacttagcagcagcagcagcaaagtgtctttaataaagagctaaaggatggacttccctggtggtccagtgattaggagtctgtctgccagtggaggggacatgggttcgatccctagtctgggaagtttccaaggcaattgggcctatgcaccacaacgactgaagacctcgcacctagagcctgtgctctggaaaaacaatagctccaaccggccgcgactggagaaacccgtgtgcagcaacaaagacccagtgcagccaaaaataaataaaaactgtttaaaaagctaaggatattctttactaaaagcaatagaaactaggagtgatatctaaataatttgtgtgctgactccaactcaagtctaccttatttttcaaaaaaagaagcattttaaaaaaggtgccaataataaaaactaccctatgggcacacttcattcctggccagtctgctcttctaactttacctgcttgaaccctgagagtagacttggcattagtaacacctttgtttatttatttatgttcacaaccttttattaaattatcaaaaataacttaacaaataacagcacaacagtggagtacacaaaagtgctgtggcatttctacaattctgttcggaaagataactcgtctggatagaaatccttcatgaagcttctggaaatcatgactggcaccctgattgccagttgtttgcgtatgtggcatacatgatattccctcactcaggacatcctttgcccagaaacgtctgtttcctgagactgtatatgtaacatgtggacaagtctggatttagtcagaaaaaccacagcggtgagaagtgctcccaaacagaatgacctgcgtcaagcagctgtggcttccctttcacaagcagtattaacaccttaattcacatgcaaatcttcctgagaaactcctccacatcagaatctattttttaaaattcagattttaaacatctaaaccaaaattcagtcctccccccatgtcatttattagaaaatacagttctagagaaatcaggagatataaggacgtctgggaagtgggaagggtacacagacttctttcaatcaggggcacagagggtccaaataaaatgagctccaggcaaaaagccagtaacgcatctcttctcctgttacctggagagctcttattataagcagaaaacgttataaaaagttagtaactaagccttgatatggtttcaacccaccctcactccacgtccgtcctttctgctcgggagacacagctacttcctctattataattgcttttgcacgtaagggggctactgcagcttcttttacattttcttttaaaaaaactttatcatatacagtacttagatcagagcagaaatataatttgaaaataaatatgcaatcaatagaaaattcatttcatgaaaccagtgtcataataaaacttcatgccatctttgtctctcctattcactaacgtaatcccaagtactgaggaaagtattcggcataaaaggcaatcggtatttgttgaatgaaaactccacgctacctataatacattttataattaaaaaagcgttttacaagttttggctgtgccagctctttgctgctgcatgtgggctctgtctggctgtggagaacaggggctgccctccagctgcggggcacgggcttctcattgccgtggcttctcttgttgtggaacacaggctctggcccgtgggctttagtaggtgtggctctcgggctctagagtgtgggctcagtagttgtggtgcatggacccagctgcttcacagcatgtggaatcttcccagaccagggatcaaccagtgtcccctgcattgcaggtggactcttaaccactggaccgccagggcagccccgccattatacattttagatgtcagtcaaaaacactgagggcttccaggtggctcaacagtaaagaatctgccccccacaatgcgggagacgtggatttgaaccttgggttggaagaccccctggaggagggcatggcaacccattccagtattcttgcctggagaatcccatggacagaggagcctggcaggctacagtccagacggtcacaaagagtcacacatgacggagcaactaaataacaacgcaaacactgatgccttcagttcaattcagttcagtcgctcagtcgtgtccgactctttgcgaccccatgaatcgcagcacgccaggcctccctgtccatcaccaactcctggaattcactcaaactcatgtctatcgagtcagtgatgccatccagccatctcaccctctgtcatccccttctcctcccgccttcaatctttcccagcatcagggtcttttccaatgaatcagttcttcacgtcaagtggccaaagtattggagtttcagcttcaatatcagtccttccaatgaacacccagggctgatctcctttagaatggactggttggatctctttgcagttcaagggactctcaagagtcttctccaacaccacagctcaaaagcatcaattatttggcacttagctttcttcacagtccaactctcacatccatacatgaccacaggaaaaaccatagccttgactggacggacctttgttggcaaagtaatgtctctgcttttgaatatgctacctaggttggtcataactttccttccaaggagtaagcgtcttttaacttcatggctgcaatcaccatctgcagtgattttggagcccaaaaaaataaagtctgacactgtttccccatctatttcccatgaagtgatgggactgaatgccatgatcttcgttttctgaatgttgagctttaagccaaccttttcactttcctctttcacttttattaagaggctttttagttcctcttcatcttctgccataagggtggtatcatctgtatatctgaggttattgatatttctcccggcaatcttgattccagcttgtgcttcttccagcccagcgtttctcatggtgtactctgcatagaagttaaataagcagggtgacaatatacagccttgacgtactccttttcctatctggaaccagtctgttgttccatgtccaattctaactgttccttcctgacctgcatacaggtttcttaagaggcaggtcaggtggtctggtattcccatctctttcagaatttcccacagtttattgttatccacacagtcaaaggctttggcgtagtcaataaaacagaaatagatgtttttctggaactctcttgctgtttccatgatccagcctaggtggtgtatattctacaggcactagcatcccagtagcttattcgtgtgtctgtgcatcattcatcaccagtgatgtgtcttatgttctgagaaatactgtactgaagaatgtgtctgctgctgctattaacctcattttagttgatcacatactctgtaccactgttctgtgcactttatacacaattagcaacacttgcaacaggcttctgtcttagatgcttcatcactggggtgtcccagaccagtctgcctggcactgtcctgctttaaatttgttgttgcagcttatctaaaatcaagtgcttctgttcactctcagaagtatcttggtttgaaagataaattacatgtggtcatattagttttttatctttacttcacagataaggaaactgatagagtaagtagcagaggatggactaaaacccatgcagaaccgactcatcggaaaagaccctgattctgggaaagactgagggcaggaggagaagtgggtgacagaggatgagatggttggacggcatcactgactcaatggacatgagtttaagcaaactctgggagatagtgaaggaccgggaagcctggtgtgctgcagtccatggggttgcaaaaagttggacttgactgagcgactcaacaacaagcctggctcaagcccatactatactatcccatactaactgctgaactggctctccaaacttgtaacctggcatattcttacaaggcaagtgcttataaagctagcagaacagaatagagaaaggaccgactaagaacacactgaaacagtgccctggaccaaagttagaacaaagagtaagagatcgtcatgaactggagcagttagtaaaagcaacagaatgtgtgaagggacacgaacgcgagaccacggtctatgactctgctcttctaatacaacggtcatttaaaataaaggaatatgaaataatctctattatgcctaaaaaatagttgtttaataagaactaaggcaaagaacaaaattggtaacaaaactcaaagttcaatttaaagaaaaagatgaaaaattttacacgatccattgtgaggaaaacaatatatagtgtgtgtatacatatatacccttgacaacatgggtctgaactatgtgagcccacttacacgcagctttctttcagtaaatacacactttacagtattacaagatcttggggtgggtgaatccacggatgcagatatgaagggtctactgtgaagttatactcagatttctgactgcagccagcagcggcagcgggtaggagcagcgggttaggcacccctgttcccgccattgctcaagggtcagctgtacacccacacacacactaacagcttattcacaatcaactagagaacagctggggcttcccaggtggctcagcagtaaagaatctgtctgcccatgcaggagacaggagatgcgggctcaattcctgggtcaaggagatcctctggagaaggaaatggcaacccactccagtcttcttgcctacaaaatcccatggagaaaaaaaaaaaaaaaaaaaaatcccatggagagaggagcctggcaggttacaggccatggagttgcaaagagtcggataggactgagcaactgagcacgcacacatgcagagaacagcagggctgtggttgaaatggcggaaccctggttctagagaccccacaccctgtttcttcatgcctgacttcctgcctacgcttgggacaagggtcacagtgagcagacagggtcttaggacccaaaacaaagtgctatacttcctctttgcttcagaaatcctttccgctgtcaactcccagtctgcctaccctcttggcaatcattaggtggaaagttagccctagggaggaggcagaacctccagaaacactgaggaagttcagggcccagcacactgatactcagccagggtgtccagaactaagactgtgcgtgatggaggaaagaggaaaacctgaccacagaagacctggtggctgattccaagacagtggctaggcttttagggacagtctcccatattctcagggtatgctctaggtcagaccctaatttctgctttaagaagctgaagcgtccagaacagagagcgtatggctagcacaatcccccaaatcttttgcttcaaaacccaaagatgaaatctgaactctcactcttagactaagtctctaactgtagcaaagaagttatacttagtatgcaaaactgccatatattttctttaaaaaaagaggaaacaccaaatgtttcccaaatttgaaaatttatggtgttaaagtgataaaaattattcagcagatccctgagtatagagtaacgtacatttgataatctgctgaaaaagtcacattcttgacagactcactgctgctgttccacttcaggaaaaaattgtcatcaatgatgtggatctcgacattttcaggcttcagatttgcttcccctgtcaagataataagacagaagacagttagacagacataccatacagttatatgtatatacatgctacagatattttaaaaaatcattctttccttgacatcactgactggacagtgaatacatttaaatataacaaaattaagtaaataaaaaaatctaaaaaaaaccctagtgcttgttctcagcatgggaagactgctaattacctctatctctgcattcaagagaactggaaaatggttgaggtttttaaaatctataaaaagcaaatattatatgtcaattatagctccataaaggtggaaaaaatgaactgtaaaaaggtacttgtcttttaactgggaagaaaagtctgtgtataaaaatagtatttttcttttgtcttagaagtgatactgacataaaggacatgggctcggctgtttaacaccctcaacttggtttttctcatatactgtgttcagacagggatatactctgacacagaactgaacagatgtggtttcagaactgacaactatttatagaagccaaacattcacatacaaaattgataagagatatgaaagttcatcatgtcagccaggtcctttagcaccctgaaaaggtcttgactgcttaacatatgaagtctgagcccttctgtttattttacagacttccatctagagacctatttcatttcctatactgttaaaaaatgtgaagtatagttgatttaccatattgtgttagtttcaggtgtacagcaaagtgatttggtgatatgtccatatttatatttatacttctagtacaaatcttccaccagctggatgctctctctgtctcttctgattcttcctttttggccccccacccaaaaagcgtttctcttcctgaccactcaaaccttccaagacccagctcaagcttgccctccaagagaaaacctttctcaaatattgcagcaaatgcaaccttgctctcttttcacactctgcaccatgaatctgcaccactcaattttacactgaagcagatgtactcagcacagtactgacatctagtaggcttaaaaacttgatgtgtgaaggtgaagacatctttttaaaaattgcttatgttaaacacaacctccaaccagaacacaagttccttaaggcagggtctgtacagctttaaacttaatcagcatttctcagcatcctcagactaatgctgagttcagaagaactttttcctcatcagagaagactgatctttcactatgataaattgcaatttttaaaagaccagtttttaagtttattctttttcctacggtagttctgccataggacaaggatgctatctccttacagactttctactataggggtggataaccaacaaagatctattgtatagcacacggaacactgctcaatgttacgtggtggcctggatgtggggaggggtggggcacgtttagggaagaacgggaatatgtacggctgaatgccttcgctgttcacctgaaactatcacaacattgttaatcggctacaccctaatataaaatgtttctggtgttaaacatgaaaataaatatatacatacagaaatacattgttccagtcatgtatggatgtgagagttggactataaagaaagctgagcaccaaagatttgatgtttttgaactgtggtgttggagaagactcttgagagtcccttggacggcaaggagatccaaccagttcatcctaaaggagatcagtcctgaatgttcattggaaggactgatattgaagctgaaactccaatacttaggccacctgatgtgaagaactgactcattggaaaagacccagatgctgggaaagattgagggcaggaggagaaggggatgatagaggatgagatggttggatggcatcactgactcaatggacttgagtttgagtaaactctgggagttggtgatagacagggaggcccggtgcgctgcagtccatggggttgccaagagttggatgtgattgagcgactgaactgaactgaaaaaaagaactttaaaaaaatggattgctgcctctggtttccatttagagatattatggtatggagtcaaagagggagatgcctgagaaaatattttctgaattttttttaaaatggggaggtatttattgagtctccccaccctcaattacctattttacacttgtattctctgagacttcattaccaaatagaattacttccctttatcccactctaaacttaattcccatgccaagctgttggaattttagattctatgcagccaaaagagagcgactgggtttatggcattaataaaaggtttgatggcatttttagtctacagccttgagagaggataaggaaatctgatacccagggtacagccaggcatttcctttgggatgaaatccttctgttctaatggaaggagaccctggaattacaggcatcttggcttttatgagaccaacaaatgtccatgggattctccagtgaagaatactggagcgggtagccattcccttctccagaggatcttcccaacccaggaatcgacctggggtctcctgtactacaggcagattctttaccagttgagctatcaggcgtggacagggacttggaaatagttattaaataagcttttagagttcatagattttgtgctgttggacttccctggtggctcagacagtaaagtattagcaatagccctttaataataatttacttcaacctttagcatgtaaaatatattaatgggtagctgcatgcatgcgtcctcagttgcttcagttgtgtttgactctttgtgaccccatgcagcctgctaggctcctctgtccatggaatttcccaggcaagaatactggagtgggttgccatgccctgctccaggggatctttctgacccaggaatcgaactcaagtctgagtttcccgaactgcaggcagatttttatgtactgagctaccagggaagccctaaatgggtatgtaatccaatactttttatacaattggttgtttccagcccttcagattcataatgatgactagaaacagtttactgtattttcaagtctgacgtaaacccaaacacataacatctatacaaatataaatttcctactatattttggacagttttcttagactaggatctcagagctgcatttactaggtttgaaagtacaaacattttgattactttgaaacacagagcagtattatgatctcaggtcagagctaacattacatttagttttgaacattactcttcctttgtgaaaaaaactagattagttaattgaaagagaactaagtccttaacatataggtggataatcaagaactaaattgtgtggtcttcagaaaacagctagcctgtaagccccagggctttggggccagattttcagggtctgatttctccctaaagcacaggctagctatatggcctcagcctgcttctctataaaatgaggataacggtgctcagctttattttgaaagctaaatgagtttgtacctttaaaacactcagagtagtgtctggtacgtagttaagagagcaaaaaatgccagttgtgtatgaagtttattttagctctcctctaatacagattacaattatgatcttaatgaacagcttcctggaatgttaattttacatgaaaattctggggaaattcttttgatatgaaagcaaacataagttaatgcaaaattttcatgaacaaaagactccaaagcaattattaggggttacaccaggaccctagtacccatatattatatacaatatttgtgggacagtctgaaaaataggtgtgaaacataataaaggaaacctcatttaaaatgaagtcaggaggccagaagccagagccctcatgtatgttcactcaccagcaattccagaccccaaaaggaaaaattctcctctcccagcaaccaacacagacaatgcgaagagtagcaccaccccgaactctcaccttcaatcaacggaatttcttttaaaaccccaccaacttccttcttttgctctataaagtaatgttctcctttccttgttggacttggctatggtttttgctgtagcttgttgttgtagtcactaagttgtgtctgactcttggcgattagatggactgtagcccaccaggctcgtctgtccatggcatttcccaggcaagaacactggagagggttgccatttccttctccagggaatcttctccacccagggatcaaactcatgtctcctgtactggcaagtggattctttaccagtgagctatctgggaagcccttgctataagcttggttgccctaaattgcaattcctctgctattctggaataaacccattttgttggtaaaaacaacatatttttaggacaagatagataggatatcatgtaccccagaaaatcagagtatgattttcaaagcaaataagcatttaagccactaggcttaccaggtgtcactagtggtaaagaacctacctgccaatgtaggtaaaggtactgagttgggaagatcccctggaggagggcatggcaacccattccagtattcttgcctggagaaacccagagacagaggagcctggtgggctacggtccatggggttgcaaagagtcaaacaggactgaagtgacttagcaagcatgcaggtggcctcaccaactcccagatttctgctctgttgcgaggccctgtttgtctttggtgtatcttcttactaccacgtcaatcttccaatagctatttcccccatgtatcccccctaaattaagaaaggtggcaaattagcttggtggctcccagccttcctatttggccctgcctggtggtccggtggttaagagtctgccttgcaatgcaggggaggagggttccatctctggttgggggattttgttgttaggacttcccttgtggctcagacggtaaagcgtctgcctacaatgcagaagacctgggttcgatccctgggtcgggaaggtcccctggaaaaggaaatgacaatccactccagtattcttgcctggaaaataccatggatggaggagcgtggtgggctacagtccatggggtcgcaaagagtcggacatgactgagagacttcacttggtcttactattattattagactgattgaatcctgagggcacagaaatccttgcacaccttactgggcatttacccgtgggatcaagaactctctactgaagagagtaaaccagcagcacagctctaagccttgtttattatttaactgtgcagtggagctgcctgacttttaggaaggaaacaaactggtcaccaaagcagtgcacacccagccctgcgggggtggaaggtgggggcaggcagcaggcacaggcgagggcgccccagagcaagcggctggggaagaatctcgaacatcactttctgttgtttcatctttggaaggaccgacgctgaaactccaatcctttggccacctgactccttggaaaagaccctgatgctgggaaagattgagggctggaggagaaggggacgacagatggttggatggcatcaccgactcgatggacaagagtctgagtaagctccgggagttggtgatggacagggaggcctggtgtgctgcggtccatggggtcgcagagagtcggacacgaatgagcgactgaaactgaagtttgatttgagtccgtttcaatgaggcactgcgaccgcggacaaccagaggtctcccaatgagggcgtctgtccctccacccccgtccccggggccgacgtttcccgcgccgccaccgcagtccagctgacgcggcagcgccgggatccctctctctctcacctgaggcggcgggcagcacccatctcccagcgaccagcatcagggtcgtcgcgcccaggagagcgagcatcgtccgcgggccgccggtagccctccagtcacatctttcggccacccactaccgcggcaggcaccgcgcggcgccgcgacagagactgaggcacccaggccgtcccgccaaggccagcgcccctagttcgccgtgtcccctccagccgctccggccccgcccactccgcgtcggcccttccctcagccctccgacctgcgcacgcgccgtgccttcacctcgtgtgtcccggtccgcgcacgcgcgcgggacagcggtgtgggagggggtggtgtcggaggcgggtggtgtcgggggaaggggtggtggtgtcgaggggggaggggcggccccgcctccgccgcccgccccctggttctcggcgttgactgcttactaagccttgcaacaccgggttccgggaagaccgcgcctcactggaggccttgaccccgggcgggaacgcggaggtcgccagggcgcctgcgcaaacctcgaggcccgctgtccgcccttcttgttagtggcagtgggagggcactctgggcgctcttggccctgggggcgggccggggggctgggaggccacgtcacggactggggagcctgggggaacggtgtcggggaggctaagtggggaaggaatgaagactctccgagcgggtcaagccatttcctttgtgcagagcttgcctggtggcgcagacgggaaagcgtctgcctccaatgcgggagaccggggttcgatctccaggtcgggaagatcctctggaaaagggaacggcttcccactcccgtgctcttgctttggaaaattccgtggatggaggagcctggtagaatggtacagtccatggggccgcaaagagtcggacacgactgagcgacttcactttctctttctgtgagccaaggcttgttgatatttagttgctaagtcgtgtccaactcttcagcgaccccatggtctgtagcccaccaggcttcttcctatgtccatgggatttcccaagcaagaattactggagtcgtttgccatctgggtaggtgtgtccagaattaagactaggcacgtagagagctgactcatttgcaaagaccctgatgctgggaaagattgaaggcgggaggagaaggggatgacagaggatgagatggttggatggcatcaccgactggatggacatgagtttgagtaaactctgggatttggtgatgcacagggaggcctggcgtgctgcagtccatggggtcacagagtcggacacgactgagcgactgaactgatgtaaagagctcgtttttggggggacgacctgggtgcgaacgtggttacctactggcgaggatccagaggatggccttgggatgctgtctggaacagaggtctgtaagctcttttggtcgtctgccctcgtagttcagtccataagtcatgtcccgcttgttgcgatcccatggactgcagcaccaaacttttaatccaagattaagtaccttaataatagattatgcacattataaaaataaaagggaaaatataaaggatgagtgatgaaataagcagtcaaagatgtagctgttaattctaacaatcaatttaattatcaactgtaaggtaaaatgagtttgtgtaaagaactttgctcttgagtgtggccttgtaaacaacaggtataatttagaggggcttccctagtgactcagagttaggagaccaccagcaatgcaggagacctgggttcaagccgtgggggctgccactccagtgtgcttgcctgcgaagtcctaacacataatttaaataccatgaaattcactcattccaagtgcacagtgatttttagtgaatctgtctagttgttaggcctattttttaaaaacttcgtattagtactctgtgattcataaatttttaggtttgattccaagtatgtcagtgtttgcttcagtgaggttgtagatggaaaaatacccggtgagaacatgtggatctaaaaggaagaaggaagttcttggttgcatttattaatcatactctcattgaaatctatgacaatgactctttgacttacagtttacattaaaagttttatttcctgctgttcaaaagttgtttttacaaactagttggaatagaacagtgggcccaaaacatctcatgaacggaaatatttcatttgaagtcttttaaaatatgttgaaaaacttccctccacttttgtgggcagctagaggtttttataaagctataaagaaagctaagcactgaagaattgatgcttttgaactgtgatattggggaagactcttgagagtcccttggactgcaaggagatcagtcctgaatattcattggaaggactgatgctgaagctgaaactccaatactttggccacctgatgtgaagaactgactccttggaagagagcctgttgctgggaaagactgaaggtgggaggagaaggggaccacagaggatgagatggttggatggcatcaccgactctatggacatgagtttgagcgagcttagggagttgctgatggacagggaaggttggtgtgctgcagtccatggggtcgcaaagttggacaaaactgagtgactgaactgatagaggttttttagatgcacataacatttggcaatgagaatcacattcaaatggaaatattttcaaatacatttttaaatgcaagaattatatttagtgaatacctatagagtttcttttgattttcatttttatacaataaaaacaattttaggggatttaatgctttgtttttcagtattgccacatgacatgctaatgttttccacttgttaaagaaaggtcaatcatattttataaaactacaattcacctttaagttgacagtacttgcatggcacagaagactttcatggtctttcccatcttaatacaataactgtaaagtttgaattgtattttaataaaattgaattaaaaaacatgaccacaggcatgacaccctgtattactttgtgcacttcattttctccttacttgctgtaaaagtttgtctctgggtgaagcattaactaatttcctgtgtggtgctagctctgtaaccttagcctagaacctctcttaccccttttattcaagtcaaaacaatccatctgaggttagataactgagcaggaccctgtgaggccttcccagaatagagcccccacgtctgtattctccaccttcccctttgtctgtagaagaactttggtcaaagaataaaattggccagagaagtgagaaaatgcagaaagaaaggaaaacagtcaagcaaaacaaaatagtagtattaatactttagccattaaagtcaaagacctttagttcttcctcagagactatagataatattctgagccatggccttggagctgttttgcagatactgaaagccccactgggtggaagaagttaaccgtaaactgcccacaagcacacagattacagaccttttggaactgaatgttgatgatgctgacccccgatttcctcaccaccaaccagtcagaagattgtccacaatcacaccccactcctagaacaccataagactcctcaccatctccctccaccagggaggggcacagagtctgagggctttaggtctttgtggccccctttgccctgcaaagcaataaagccctttctttctatttcattgcaaactctgtctccagaatgtaatccagtgccagtgtatacagaggctgagatttggcatcagtgacacttgcagtttttctataaagcgtagtattttggagcttcccaggtggctctaatggtaaagaatgtgtctgccaatgcaggagacttaagagactccagttcaatccctgagttgggaagatcctctggagaagggcatggcaacccacttcagtattcttggctggagaatcccatggacagaggagcctggtgggttacagtccatagagttgcaaagagctggacacaattgaagtgacttagcatgcatgcatggtctttttaacttttgaaataatttcaagcttggagaaaagttgcaaaaataataaaagaactcctgtacatcctttactcagattcaccaaattgatattttgccatatttgtaatctctggctacacacacaagtatgcatacaaacttctttttccttgaacttctttagctttctttaatctggaacagttacctggtcttggtctttcacaacgcctactttacttttttaaatacaactaattattttatctattgtttagtcactagtttgggaaggtctcctggagaagtatatggcaacccactccagaggagcctggtgggttatgagtcggatatgacttagcaactaaacagtaataacaacgcattcctgaatggaatactgcataaattgtgttgtgtcgtctgatatttcacctgaagccacactgtgttccttagtgcctgtttggtgatgctaattttgagcagatggtcaaggtattggtcaagcagatggtcaaggtgctatccaatgtcctattgcctcctcacaataatctgtggagagatgccctgagatcctgcaaatactcagctcttagcaaatttttacatctagaaagaacatcctttgatgatctctgcctgagccagtctactctgatggctgggaaatggtcgttttcaactgtctctccaaatgcaagtactggttgacacattgtcggagagagatttctcttctttccatttattatcagtatggatccactgggaaaagagtacagcaaggttgtacattgtcaccctatttaacttatatgcagagtatatcatgagaaatgccaggctggatgactcacaagctggaatcaagattgcctggagaaatatcaacaacctcagatatactgattgttgttgttcagttgctaagtcatgtctgactcttttcgaccccatggactacagcacaccaggcttccctgtccttaaccatctcccagagtttgctcaaactcatgtccattgagttggtgatgtcatccaaccatttcattcaagtagataatacttcactttctaacagtagaaagtgaaaaggaactaaagagtctcttgatgaaggtgaaagagtagagtggcaaagctggttaaaactcaacattcagaaaactaacatcatggtgtctggtcctatcacttcatggcaaatagatcggggaaaagtagaagcagtgacagcttgtcttttcttgggctccaaaatcactgtggatggtgactgcagccatgaaattagaaaacacttgcttcttgggaggaaagctatgacaagcctagatagtgcataaaaaacaaagatatcactttcccaacaaaggtctggatagtcaaagctatggtttttccagtagtcatgtatggatgggagagttggcccttaaagaaggctaagtgccaaagaattgatgctttcaaactgtggtgctggagaatactcttgagagtcccttggactgcaggaagatcataccaggcaaccctagaggaaatcaaccctgaatattcattggaaggaccgatgctgaagctccaataatttggccacctggtgcaaagagctgacttatggaaaagattctgatgctggggaagactgaaggcaaaagaagagagtggcagaggacaatatggttagatagcatcattgactcaatggacatgaacttgagctgactctgggagatagtggacagggaggcttggtgtgctgccatccgtggggtagtgaagagtcggacatgacttgaacaacaacaacagcaacaacatggatttatagattcttattttatttaatgtttatagtttattactatccttatttatttaaaaactttaaaaattaattagacttcactttttggagcagttttagatttttggaaaaattgagcagaaagtactggcagttcccttccatccccttccgtcccacctcagtttcccttgttgctaatatcttgtatggtacacttgttacaaataatgattctacaagataaagtaaactgttagttgctcagtcgtgtctgactctttgcaaccccatggactgtagcccaccaggcttctctatccatgggattctccaagcaagaatactggagtgggttgccattccctactccagggcatcttcctgacccagggatcaaacccaggtctccagcattgcagggagattcttgaccatctgagccacgtgggaagccattgacacattattattaactatagtgcatcatttgaaaactggtcaaccacttgtaaaagaatgaaactagaccactttctaacaccatacacaaaaataaactcaaaatggattaaagatctaaacgtaagaccggaaactataaaactcctagaggagaacataggcaaaacactctctgacatacatcacagcaggatcctctatgacccacctcccagaatattggaaataaaagcaaaaataaacaaatgggacctaattaaacttaaaagcttctgcacaacaaaggaaactataagcaaggtgaaaagacagccttcagaatgggagaacataatagcaaatgaagcaacggacaaacaactaatctcaaaaatatacaagcaactcctacagctcaattccagaaaaataaatgacccaatcaaaaaatgggccaaagaactaaacagacatttctccaaagaagacatacagatggctaacaaacacatgaaaagatgctcaacatcactcattatcagagaaatgcaaatcaaaaccactatgaggtaccatttcacaccagtcagaatggctgcgatccaaagtctacaagtaataaatgctggagaggatgtggagaaaagggaaccctcctacactgttggtgggaatgcaaactagtacagccactatggagaacagtgtggagattccttaaaaaactggaaatagaactgccttatgatccagcaatcccactgctgggcatacacactgaggaaaccagaagggaaagagacacgtgtaccccaatgttcatcacagcactgtttacaatagccaggacatggaagcaacctagatgtccatcagcagatgaatggataagaaagcagtggtacatatacacaatggagtattactcagccattaaaaagaatacatttgaatcagttctaatgaggtggatgaaactggagcctattatacagagtgaagtaagccagaaagaaaaacaccaatacagtatactaacgcacatatatggaatttagaaagatggtaacaataaccctgtatacgagacagcaaaagagacacagatgtatagaacagtcttttggactctgtgggagagggagagggtgagatgatttgggagaatgacattgaaacatgtataatatcatatatgaaacgagtcgccagtccaggtttgatgcacgatactggatgcttggggctggtgcactgggacgacccagggggatggtatggggagggaggaaggaggagggttcaggatggggaacacatgtatgcctgtggcggattcatttcgagatatggcagaaccaatacaatattgtaaagtttaaaaataaaattaaaaaaaaaataaagtgcatcatttatatttggattctctctctgtattgtatagttgtatgggctttgccaaatggttaatgtcatttatccactactgcagtaatatacagaatagttttactgctccaaaaatcccctgtactccagctattcaccctatttatttatttattttttacatgaagaaaactttttgtttttcttttttttggctgcattgggtcttagttgtggcacatgggctcttttgttgcagcatgtgggatctagttcccttgaccagggatcgaacccacataccctgcattggaagacagacggttaaccactggaccaccagggaaatcccttcaccctcttcattattagtgctcagattgtcccagttttgaccagtgagagccatttcaagctggctcctgtttctttggatacaatctaccttttttctacctctttttttttttttttaatcatttctttactttcagggataagatgttctaggctcatcttatacttttcctgccccagccctgaaattagccatctctccaagggacccaggcttcttttagtgggttatagtatttagaaaccaagatcagggccctgaaactttggttttaattacagaaatgcaaatcacaaagtcaaaaggaaatgagctaaggaagtctgtttggcctagtgtctaatccagcagataaccatttagcaccattttgtttctttttttttttttccagactgtggaacatttgactgataataatatcagtcaaggataaaggtaggcttaaaaattgggtggataaaggataaggaagtccattttactctgtcaactctgtgctagtttagtcgctaagtcatgtctgagtcttgagaccccgtggactgtagcccatgaggctcctctgtccatggaatttcccaggcaagaatactggagtgggttgccatatttcttcaggggaccatcccgacccagggatcaaacccaggtctcctgcattgcaggtggtctcccgcattgcaggtggactctgctgctgctgctgctaagtcgcttcagtcgtgtccgactctgtgtgaccccatagacagcagcccaccaggttccccatccctgggattctccaggcaagaacactggagtgggttgtcatttccttcttcaactgttccctaaagatgtagaatctgttttcttagtatgggctgaacagtgactggcagcagttttagaagggaagtgggtggtttgtcatagggcagcaattacatgccctttagcagtaggagtgcctgcacagattaagaatccgggggatttccaagttgagccaacagcagggcagactctgatgaaagtgacggttttccctttcgctaatgcgcacactctagtaaaggctttgagttcagcagcctggactggctttacagtggcttcaagtgtttcttgtggagagactatggcataactagctattatgtttctgtgaaaatttcacttgtacgaggcatcacaaaagagaagtctgggttgtctggagggatgtctgagaggtcttcttgtggctttgagactgtttcgtggctgcaaggcaatcatgtggaatgaactgggctctccgtcaccagggaggggcatgaaatagctgaatttagagtattacgaagatggaagatgaaggaagggggagttaaaagagcctgctcatgggtggtttgtttcctctgcagggagatgctgcgcactatgatctgtaaggtagaggacacagagtgggcaacagaaacctgcatttgggagcctcttcttagagtactggggcttcccagggggcgctagtcgtaaagaacctgcctgccaacataagagatgtaagagacgcattgaacctgtgtgtctgtgtctgatcttccctgggttgggaagatctcttggaggagggcatggcaagccactccactattcttgcctggagactcccatggacagaggagcctggcagggttagagtactagctttgtcaatccaggtggcagctgtgcccacgcaggtcagcgtggggccttacctaatgctacagggtctttttggcatgagagataagctacagactcatccaagaggcaaaaggctgtcctgtaatgcctgtagccactctattgctttcatggcagcatgatgaaaaggtctgtcaaaaggaggtaagccaacagctggaggtgtagccacagtctatctggaggctgccagaaaagtagcaaaaggcttgctggtgaggccctgaagatattagggtgggctgagacatgggcgatgaggcaatgcccgcagactccagctgctgaatagattcagaagtgacaggtagagagaaggcttttgagtggatgggagaaagtctcaccagtgtcaattaagaaatccaattaggagcctctattctaagcttaatggtaggctttcggggttgaattgaggatcagctgacactgtcatttgagggaatttttgtccctcaggaggagaaaaatgaacgtgggagtactggggcctagaggggtcttaaaccttccttcctcttaagtgcaggacaatttctcttccaatgtctggatttcttacaatatctgcaattgtctggaggcaaataggaagatctctgagtagtcttggagttgctcttagggtcttgcttttgtttttctgaagattccagttgcaaagcaagaactgtttcttttattaataactcttttccccctgcagcatttattcctgcagactattttcaaagaattggctgcagcttccattattagcttagtggttgcccagacaaaccaatcacaccatctttttttagtgccatgtgttttttttttttaaatacattttatttatttatttgtttggctgtggcatgcaggatctgctatcttccttggaggcttgtgagatctttagtggtggcacgtgaacccttagttgcagagttctcattccctgaccaggaatggaacctgggccccctgcaggaagaaggtggcgtcttagccaaaggaccaccagggaagtccctgaccacactatttttaatttgcttttaataatagggaaaacatttcccactaaagcagacatgaggagatccctgtgtcctaaggctttcagctgcagtgctgtgtgcccttgaaaagtttgtataaaacatttaacaaacactttggatgctttccattcttctgagggtataattccacctcagaccaagtaattctgggggaaagacctctagtattgcttaaacagcagacttacgggtcctatgcatatgttctggccggtatttcttcttccttctgacaaatgacacaacagagagagacaagggaaaacagtgaccatctgggagcaaggaatcaatataaagcaagaatactcatttaccaaatggtggaggctctatgtcataaggaactggctccaaaacctcctgcaaatctaaacagaagagagaaagggaactcccacgactttcccctcaaccagaccttgtaggcagagacctgggtgcgtgtgtgttagttgctcagtatgtcggactctttgtgatcccatagactgtagccaggctcctctgtccatggaattctccaggcaagaatactggagcgggttgccatttcctcccccaggatatcttcccaacgcaggaattgaacccagatctcctgcctttcgggcagattctttaccctctgagccacaagctggtctttgttatgtgtcccaggatttctcagctgtagcagtcttagggtggcagtctggccagtctcctggctggcttaccaactgtcagggaggaggaaacatcctcctcttgagttcttgcaggtggattactaatgaaatagacacagacaggttaacaggagaagagaaacaaacataaattcatgcacacggagttctcatagaaatgtactctaagaagtggccaaagcaggcagcttctgtactttttcaataaagaaataaatctctgaggaataacaggacaaagaaacttggttttaggtgcttagttagtgactaatctaaacagaatttgggcttgggtagtaaattaaagaaataacaaggttggattccctgtcttctgaattccccatctctcctgataaaggtgtcctacttctatttttcacatgggagacttatttcctgcttttcaaggggacagaggagggtcagttttttcttgcattggctacctctcttttggctcagggggtgcacccaagtctgctattctgaaggatcacacagccccagagatcgaaacttctttgtctaacctcagctgggctgaaatttaaaccttctgccctcactgcacatctctgcccccctgcttcccacttccaacagatgtcccacccaactcctaccttcttcgaaaattcaagcagccaacagatcagactgcagtttctcaccaccaaaatctcacacacacctgaaactgcagcccttctctctctctctctttttagccctttattaagttgagaggtttgatttttagactgaaggctatggagattatccgaaaggcgttcttcaaaaggagaaataacttgctccaactttccatgtagaaacattctggcagcagggtggagagtgagttagagagaacagtgggagaaggaaaggtttcttaaagtatgattgcatgcatccttttggatcacgttcttcttcagatatatgcccaggagtgggattgcaggatcatatggtagctctatttgtaggttcttaggggacctccatactgctctccatatgtaacaacctaaacgggaataccatttgaaaaagaatggatacgtgtatatgtataactgagtcactttgctgtacacctgaaactagcacaacattgttaaacagctgaaagatttagaggatctgaagagaaaccagagcctgtagctatcacaacattgtgagtcagctttgttccaatataaaataaagagttcaaaaaaaaatacagttacaataaggcttggatgaaagggttggcctttaaaggcagaactggagtcatggataagggaaggagctagtgaatatcatggagtagcatctatcttttgctaattagttgtagaagaggttgtagttgaggatgatggaagaaatgttcacatattgaggaatgaggaagtcattctagcttacacatgatttaaatttatgctaaccagaacagcttgttttgtggcctattaaacatgcattgtacatctgctttaaccattaaaggaaagaatgcatttaaaactcaatatggagtagctatacttcaagcattgaaaatggaactggttagtccctgtggatgtggtttcagacatgttccagcattactgggaacttgaattttcttaacttgaagacaccatcagaccattctcaaaacaattatctgccagcagctgccagctggagccttctggtctcaacttcttctctgtaaccaagcaactgtttcagacccaaccaatccttgcttgacaagcacccacatttcttgtcagttccaattataattcttgacaaacttatataattttgtgggttttgcctctataagcctcccctatcttgtcatccagcagagcacagttcaagtacttcttgaatctgcatcttccaggctatagtcctcagtcagttcagttcagtcgctcagtcgtgtccgactctttgtgatcccatgaaccgcagcacaccaggtctccctgtccatcaccaattcctggagtctacccaaacccatgtccattgagtcggtgatgccatccaaccatctcatcctctgttttccccttctcctcctgcccgcaatctttcatagcatcagggtctcttcaaatgagtcagctcttcacatcaggtggccaaggtattggagtttcagcttcaacatcagtctttccaatgaacacccaggactgatttcctttaggatggactggtttgatctccttgcagtccaagggactctcaagagtcttatccaacaccacagttcaaaagcatcaattctttggcgctcagctttcttcacagtccaactctcacatccatacatgaccactggaaaaaccatagccttgactagatggacctttgttggtaaagtaatgtctctgcttttgaatatgccatctaggttggtcataactttctttccaaggagtaagcatcttttaatttcatggctgaaatcaccatctgcagtgattttggagccccccaaaatgaagtcagccactgtttccactgtttccccatctatttgccatgaagtgatgggaccggatgccatgatcttagttttctgaatgttgagctttaagccaactttttcactctgctctttcactttcatcaagaggctctttagttcctcttcactttctgccataagggtggtgtcatctgcatatctgaggttattgatatttctcctggaaatcttgattccggcttgtgcttcctacagcccagtgtttctcacgatgtactttgcatataagttaaataagcagggtgatcatatacagccttgatgtactcatttttctatttggaaccagtctgttgttccatttccagttgtcagtttggctcaaataaaactattttctattccaattatagactgtttatttctgtcagtaaggatgactcctaagtttccaccttgaggaatgactttatggtgagcccataaccaagacataaaatagaaaaggaataaagaaaaaggtggaaaacatgagtttatgttgagacctgttagagcaggtaatggctgtatatagaagtctgagttggaaaaatagatttcatagtcatccgccttatattttactaaatgaatccatgcatgtgtatgaggtccctaagagggaaggcttatagaatgagaatgacagaaaactgaggaacaggcatgtaaaatcagaaaggaaaagaaaatctgcaaatgcgtcccagaagggctaaccagagaaaaaagagaaaccaagagagtggcatagtctttctttctttttacttatttgttaaatttttttaaaaattgaggtatagttgatgtagaatgttatatgcttcagatgaacaatttttaacaatatgttagtttcaggtgtacggcaaagtgattcagtcatacataaacatacattcattctttttcgtattctttccccatataggctaccacagaatactgagtaggattccctgctatactgtaggtcctcgttagttttctatcttctatacagcagtgtgtgcacatttgtcccaagctcctgattcatcccttcccaccatgtgtccataagtttgttttctgcatgtgtaagtctgtttctatttttgtaaataagttcatttgcataatttaaaaattgtattccacatatgagtgatatacaatatttgtcttcctctgacttggttcacttagtgcgataatctttaggtccatcctcgttgctgcaaatggcattatttattttttttttatggctgactaacattccattgtatgtacatgccacatcttctttacccattcctctgttgatggatatttaggctgtcttagctattgtgaataatgctattgagacgggaatctgagatcttgtctgaggcgctgaagaatggaatccatgaacatgcaaacactcacagtagcaagtgaataggatttattaaagaggaggaaagtacaaaactctcagtatagacactgagagggggtaaagggtccccccatggtgggacttacagcagtttttatatccttccttaaatcgcattattcctaaccaatcaattttttaaaggtcaagatacttaacattttctcttgatccttgaattaagtcgccaccctttttcatgacctctggccattttgccatgaacctgatgtatgggcttaaggttaatgatcacaagttgtttttccctcaagcatgtggaacagaatttaattactgcccttccctggatctgagtgctgataatttatcagactaaagacactttcctagataccatattgaaaagcagagacattactttgccaacaaaggtccgtctagtcaaggctatggtttttccagtggtcatgtatggatatgagagttggactgtgaagaaagctgagtgctgaagaattgatgcttttgaactgtggtgttggagaagactcttgagagtcccttggactgcaaggagatctaaccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggacgacagaggatgagatggctggatggcatcactgactcgatggacgtgagtctgagtgaactccgggagttggtgatggacagggaggcctggcatgctgtgattcatggggtcacaaagagtcagacacgactgagcaactgaactgaactgaaagacactttctaggaattcaggacaatggagcaggatgcttactgaaaacaagactcagagttctacactaactgcctagtaatttctacctcacagttataaacctaggggtgcatgaatcttttgggattatattcagttcagttcactcgctcagttgtgtcccactctttgacaccccatggactgcagcacaccaggtttccctgtccatcaccaactcctgagcttgctcaaactcatgtccattgagttggtgatgccgtccagccatttcatccttggttgtcccctcctcctcctgccttcaatctttcccaacatcagccaaaaagtttgttcaggtttttccataagattagtcttagtgaaaaatgaactttgtgatcagcccaatagttttgtctggatatatgcccagaagtgagattggcatttttagttttctgaggaaaccccatactgttttccgtgctggctgcaccaacttaatctccaccaatactataggagaggtctcttttctccacataagctctagcatctcttatttgaagagctttaaatgatggccattctgactggtgtgaggggaaaaacctaattataattttaacctgcatttcccctaatatttagcaatgttgagcatctattcatgtctgcactgagtattaatccaactttatttgcatgtatggcctggagactaacttggatatattttcaagatttatcttcctcaaataaatttaaatcaggctgagtttctagtaagaaaagtaagaaatttggggcttatttgagaggatgagatggttagatagcatcactgactcagtggacatgaatttgagcaaactccaggagacagtggaggacagaggagcccaatatgctaccatccacgaggtcgcaaagagtcagacacaacataacaactgaacaaaaacagttccgtgacttccattttctctccttcactccttctcatcaacaataaaacattcccaggtctctcccatcttcaaaaagtatgtatcctttacttccccagaagtagtttttctttcctgtcatttacagccaagtttagctacccatgaacagtatgaaaagacaaaaagatatgacactgaaagatgaattccccagatgggtaggtgcccgatacactactggagaaaactggagaagtagctcagagaagaatgaagaggctgagccaaaacgaaaacaatgcccagctgtggatgtggctggtgatagaagtaaagtctgatgctgtaaaaaacaatactgcatagaaacctggaatgttaggtccatgaatcaaggtaaattggaagtgatcaaacaggagatggcaagagtgaatatcaatattttaggaatcagtgagctaaaatggaatggaatgggtgaatttaattcagatgaccattatatctactgctgtgggcaagaatcacttagaagaaatggagtagccctcatagtcagcaaaaaagtcagaaagacagtgcttggatgcaatctcaaaaatgacagaatgatctctgtttgttttcaaggcaaaccattcaatatcacagtaatccaagtctatgccccaaccactaatgctgaagaagctgaagttgaatggttctatgatgatctacaagaccttctagaactaacacccaaaaaagatgtcattttcatcataggggactggaatgcaaaagtaggaagtcaagagacacttggagtaacaggcaaatttagccttggagtacaaaatgaagcagggcaaaggctaatagagtttggccaagagaacgcactggtcatagcaaacaccctcttccaaccacacaagagaagactctacacatggacatcaccagatggttaacactaaaatcagattgattacattatttgaagatggagaagctctataaagcaaaaacaagaccgcaagctgactgtggctcagatcatgaactccttattgccaaattcagacttacattgaagaaagtagggaaaactactgggttttcattcaggtgtgacctaaatcaaatcccttaagattatacagtagaagtgacaaatagatataaaggattagatttgatagagtacctgaaaaactatggacagaggttcgtgacattgtacaggaggcaggggtcaagagcatccccaagaaaaagaaacgcaaaaaggcaaaatggttgtctgaggaagccttacaaatagctgagaaaagaagagaagctaagcaaaggagaagaggaaagctatacccattgtaatgcagagttccaaagaatagcaaggagagataagaaagccttcctcagtgatcaatgcaaagaggaaaacaatagaatgggaaagactagagatctcttcaagaaaattagagataccaagggaatatttcgtgcaaagatgggcacaataaagaacagaaatggtatggacctaagagaagcagaagatattaagaaggggtggcacgaatatacagaagaactatacaaaaaaatatcttcttgacccagataaccacaatagtgtgatcactcagtcagagccagacatcctggaatgcaaagtcaagtgggccttaggaagcaccactatgaacaaagctagtggaggtgatggaattccagttgagctatttgaaatcctaaaagatgatgctgtgaaagtgttgcactcaatatgccagcaaatttgggaaagtcagcagtggccacaggactggaaaaggtcagttttcattccaatcccaaagaaagccaatgccaaagaatgctcagactactgcacaattgcactcatctcacatgcaaagtgatgttcaaaattctccaaactagacttcaacagtacatgaaccaggaacttccagatgtgcaagctggatttaggaaaggcaaagggaccagagatcaaattgccagcatctgttggatcatcaaaaaagcaagagagtttcagaaaaacatctacttctgctttattgactatgccaaagactgtgactgtgtggatcacaacaaactgtgggaaattcttcaagagatgggaataccagactaccttacctgcctcttgagaaatctgtatgcaggtcaggaagcagcggttagaaccagacatgggatcatggattggttccaaattgggaaaggagtagggcaaagctgtgtattttcatcctgcttgtttaacttatatgcagagtgcatcatgagaaacgctgggctggatgaagcacaagctagaatcaagatttccgggagaaatatcaataacctcagatatgcagatgacaccacccttatggcagaaaattaagaataattgaatagcctcttgatgaaagtgaaagaggagagtaaaaaagctggctttaaactctgcgttcaaaaaccaaagatcatggcatccaatcccatcacttcatggcaaatagatggggaaacaatagaaacagtgacagactttatttccgtagactccaaaatcactgcagatggtgactgtagccataaaattaaaagacacttgctccttggaagaaaacttatgaccaacctagatagcatattgagaagcagagacattactttgccaacaaaggtccgtctagtcaaggctatggtttttccagtagtcatgtatggatgtgagagttggactgtgaagaaggctgagcgctgaagtattgatgattttgaactgtggtgttggagaagactcttgagggtcccttggactgcaaggagatccaacccgttcatcctaaaggaaatcagtcctgaatgttcattggaaggactgatgctgaagctgaaactccaatactttggccacctgtgtgaagaactgactcattggaaaagaccctgatgctgggaaagattgaaggtgagaggataaggagacaaccgaggatgagatggttggatggcatcaccgactggatggacatgagtttgagcaggctctgggagttggtgatggatagggaacgcctggtgtgctgcagtccatggtcacaaagagtcagactggactgagtggctggactgaacttagatacatttatccacactgtctttgttttcttacttcccaggtattcctccacatactaagtctggctgtcccttctaccattgtgcttaccttgttctcagcaagatcaccagctagtttcttcaaagctattaagactctttccaggctttatcttatctgacttctcaatagcattgtctatctttccctgttcccttcttctcaggcctcatttcatttcacactcttttgctgtttcttccatccctctggccactctcaatctccattgcaaactcacaccagtgctttttagttaatattaatgtcctcaactgctttgtcctgggccttctttctactcattttaaacgatctcccctcatgatctcttcccctccatgactttattgactgtcatatacactgatagctccccaaattgttattagcttagatctctctcttgatttccagatttgatacccagcagcatatcagaaatatttctcagtcgttctgcatcccatttgaggattctgcttccaggccaaaatcctagtgtgacttttcagtccagatcacaggcaagaataaagctttgcctggcaggggtcctcagtaaagggaagctaagttccatataccagccccccaccttcagcaaggctagctgagttcaaaggcatatctacattctagggatgtctgttcagaggtctcagctgaggtactttcgtctactttgtttgtttgattgatttggctgtgctgggtcttagtttcggcacatggatctttgacccttgtgtcagtatgcaggttctttagttccggcacgtggggtctttttagttgtgacacgcgcgatctttagttgcagcactggaactctgagtagcgacatgcaggatctagttccctgaccaggcattgaacctgggccccctgcattgggagtgtggagtcttagcccctggactacctgggaagtcaccttttctctgctttgattcagtaccttttctctccctccctgacctcctttgttcaggggtccttggaagtgagacatttctcctgtctgcgctgtatctgggacttccctggtggctcagatggtagagaatccacctgccatgcaggagacctgggttcgatccctgggtcgggaaactgactggcctgagcagtgctgcggggaaagggaacacaggagagcctccatggtggctctttggcaggctcatagaattaagtgaataaaggcttgctggttactttcagtttggctcttgccctaatggactacctggacactttgattgcttgacataattcactgggccctttcaatttgaaaactgtgtctctctttggcttaaggaaatagagttgttgagtttctagatctttgtgtatttataattttcgtcaagcctgggaaattattaggcatgatttttttcaaagattttttttctttactgctccctctttctaaacacacatatattaggttgcttgaagttgtgccacagcatactgatattcttttcacttttctcccaatcttttctctctctttctctcattttagatagtttctgttgctatgtcatcaagttcactggtctttttttttttcctgcagagtctaatatgctgttaatttagtatatttttcatctcagacattgtatttttcatcgtcatgagtctgaatttttatagctttcatatctctttttttaacataagaatgcttccttctactttcttgaatggttttaatgttccaacctatgaattctattcatgctttttaaaaaattgatttccttcctcattatgggttatattttcctgcttctttgcatgcctggtaatttttgatcagatgacatatattgtaaattttatattgtttggtgcttgaagtttctgtgttcctgtaagtatgcttgagttttcttctgagatgcagttgaggcattttgaaagagcttggttgttttgaggcttggttttcttaggtgggagtggagaagtgttcagtatgtcctaaatttgcccgactgcctgatgtcccatgagtcatcaggttttctgctctggtgggagaactatccctactctgtatgagtccgaggtattgacctcactgtttctttgggtgggtcttcccatagcctcaagttttctcataacacatgctctgatcagtacttaagcaaacatttgagggagcccctttgcagatatctagagctttctctctgtcagaattctcctccctgttatcctgccctgtgaaatccagctgcctcagtctttgtgggctcctagttccatctcttcaacccataggggctttgggttcctcttcctcctctctttgctgatgcctggcagttctctctggaaaatcagcttgggcaatcacagagcttatttcagttgtttctcttctctcaaggatcgctgtcctgactgtgatcagaaccggaagttctgtgatcatctgaaccagaagtcccaccattgtactgtttttcagctactttgtcctctccattttctctgctttcttattactaggatattttactttctgcattgaccctcagtgtctctcaatctgcttattctatctatttttaaatttctttgtacttctgcgcatgattttggaggacttatttgaattctaatgaaatttttatttctgcaattgtgaaagcacgttattattctgattttttttttaaagtagcaccttttcttgttttatggatccacaagcacctcaaatcttttgaacttgggtttttgtgacattcttttctgttccaatagtctgttttgtcccgagtcaatttgctctatttgcttatctttatacttttcttttatgccactagcttttctcattgtctggtaatctttgggcatatatttaactgatcaaaagttgtttttttctttcaaaacgcaccaaaaatggttgttgagcatcataactgatgtattatttaatagaatatgttgtgtctgggttggaggtaataaaaggttatgaatccacaacagtaggctctttttggtgcaactgctgagaccacagaattatgaaagtgattcataagggaagccactgagagccatgtgtacccacctgttttttattttgatcatttgcaatgcttatttcctgcttcaggaataaactaaaatagcactccatcctaagagggcctgagtcctatttttccatcttagagttgggaccagacattattgcctggtcttgagtataccgatgctgttgtaaaccatgacccttggggatcccttgacctgtctgtgtacatctgctattggggaacacatctatacctgtgttggatccagcctagaagttgtcaggaatgatacgtgggggtacaaataccccagcttcctaatcccttgacaggatacttctgaggaatgtgttctacaccattttcttgagcttctccatgggattaagatttgctcatccactttgaaagctggttcactggaaatcttcctttccctgtgtcatgttctcactgctcttgtctttgcacctgccaggaaaactacatgctgtcagtcatcatcttaggatcttcttcggcggggaatccagttgagatagagcgtaatgtgaaccgaaagctgacaccttctccatttctacctctaccaaaagccccagtcctttctctctggagattcataaagagagtctggtgaggagggacagatatctactcttgtgcttccgagggtgtatctacccctgctaatgggaggaagaatgcctgtactcagaatgcggcagatctgtctctaagactgttaaaccacaaagaacacaaacctgccagccgggcagcagcacagacctcagctgtcagaaagaatctcttctgctgatgttggtgtttcacatccactatctccaccacagtgggtgctttgtgagtcctgcaaaataagaaggcacaacaatacagaaatctgcaaatttcataataaattaacaattgctgcatcatttaagggagcatccttccaccttttgtgtgcctcagagtccctgtgtcaggacagagagttatttataagtctcactcctagagcttctgattcagtactgtcaggctgggaccagagagtttgcatttctgataggtttttctggtgattgctgctgtccaatgagcacatttggagaatcattgctttaagaaattttgagactggtgattatatttttttagcctctgttcctttcatggaattttctaacacaatctttctagttttccacgtgattgtattgtattgggttgggtaaagagtttgcttgttttttttttttttaacccataagatgtgatgggaaatttgaacgaactttttggctaacccaacatctagtggattcaaagtttcttattagggatgataggatgttcagaattttctactatatcaggctagcctcttccactagcatttctttagtcccaataaaatattagcctactgcgttgatttttaaatgccattggaaatctcgttattctcagatgtgacaatgaatatagccaaatataatgcaaaggcagttcagtttctgtcaaaggtacaaagtttccaatcttttaggacactctttacctgcataaagtgattgcctttgaaggaaaagctttgattttcctaagtctgaataatttgtattgtacttcccagaataaagaacaaagtcccctaaggagtttgtggactgcagtgtttctggaaggtagaaaattggtaccaggaatggggtggagagaggagagggaagacccgtgctgcgaggccctggcaagcgtggccagcaaacaggaatgccaccagcagagcttaccggtgcaccgtggggacccagacggtgcgggcaggttggagaggaggagcaagggaacaggggctaggcggctctgaggagggaggcgtggagcaaggaacagacgcaggagagagagaaaagtggtcccaggggtggggtggggagccaaaagaactccccgagttggaagcagcagagatgcagctgcttgtcgcaccaccagtgtgacttaagcagaaattgtctctgaagggccctcatcaggaaatatgctaccattttctgtaataagaaacactgtaagcttcaaccgctctgttgaagagcaagatacaaaaaaggttagaggctattttatttttttaaatgtttcatcctatattgcctagggctgattaatgatgttgcaatagtttcagaaggacaacaaagggactcagccatgcatacgcgtgtatccattctgccatgccaaatcttctcaagtttatcaacagttaagatgaaaaaggaaatgaggctttctggagaaatataatgtatttgatgacaaatacatgaggtctgtttgtttttggaaatggaatttgctccaaatatggtaaataagcacactagtcatacttaacataccactctaatctatgccaaaactaactgatctgctaaaccagtgatgtgttattttaattcttcactgtggtcgagattctttcattacttagaaagcactaaattcctgtcttagctttatctttacagatcccctgcaaaaagcattgcctgaaactacccagatattcatcaatgggtgaatgagcaagtgctgtgtgcatgtgtgtatatgactattattcttcacgttaagtgaaagaagacagacataaaagggcacatattgtgtaaccccatttatacacattccagtcagaataagccaatctgtagagacagaaagctgattggtggttgccgactggggggcggggagaatggggagtgattacttaataggtatgggtgatgaaagtggaacttgatatgggtggtgattgttccacactgtgaatgtgctaaatgaaactcaagtgtacactttcacaaggtcaatcttatgttatgtgaatttcacttcagtgggggaaaaagaaaaaacattgcctgtggtgcagtggattcaactataacgcgaagctttctgtcttaagggctggggatctagcagtgaacaagacacacagtctctgacctcccagagcctgcagtttaacatggacacaaacagctctgtaaacaaatatttgttgagctgaactgaaataacgtaaaagctctgggagctggtgatggacagagaagcctggcatgctgcagtccatggggtcgcaaagagttggacacaactgagcgactaaactgaactgaaggtcaagtaatgatacctgctatgagaaagaaccaagcaagacaagggacagagataagtaagacctctccaaaaaggagacattgcagcagaaatgcaaggacatgaagagagggctgtgtaaacagagaatgttctgggcataaggagaaacatgtgtgaagcctctgagacatacatgtgtggcatgtcgttggcacagcaaggaggatgaaggagctggagtgcagagagggaggggtgcagaggaaaggagccaggcaagtagtctgtagggcctgcaggctctggggagggtttgggttttgtcctgagtgaaatggagaccattatagggatttcagcagaggaatgaacttgtgtctcaaaaggatcactctggtttctgtatgttgattacagtattgagtggtgggctggagaggaagtaaagaaacctgttgagatggtcctatagtaatccaggtgattggttaaaggagggctggttggggtggacagaactgctgcacattgcagcaaaaaaagaaaaaaaaaaaaaaaaaaaaggcttccctggtggaccagtggttaagattctgcctgccaatgcaggggacatgggttcaatccctgtctgggaagatcccacatgcctccaggcaactaagcccatacatcatagctattgagcctgtgctctggagtcgcaattactgagcccatgtgctgtaactactgtgccccccaacaagagaagccaccataaggagcccaagaagagaagtcaccttaaggagaaggctgagtaccacaacgaagggtagcccacgctagctactactagagaaagcccatgagaggcaacgaagaccctgcaccgcacccttccctcccccgaaagctccacattggactgttctgaaggtaagccatacaagtctggtgatggatcgtatttaagagtgagagacaacgaggagaaagagatgactccaacattttggccaggtccttgactctgtaagtctttggttcttcatatttaaagcgagggggatttgactaggccatgtctaacactccttccagcactgagagtccaagattctaaggaacactggacaatacacagaaatggaaggaccaaacctcagtttgctcatctgtgaaatgcacccatctgaggctggtggtgaggagcaagtgaggtcatagttaacactagcatgccctgagggtcaactgctagctgccttctttttcttttgggtagcaagagtaaaagttttatattggcacacgtcttcctttctcttgggtatatctctaagggtggaattgctgggtcaaatggcaattctgtttagggaacagctggactcttctctgaagtggctgcaccattttacaatcctaacagcagggaacaggagttctgacttctccacatccttgccaacacttgttatcatctgtcttttaaattacggccatcctattggacgtgaagtggtatctcactgtggtttggatggtgttgctgtgatggttaatgatgttgagcaacttctcacgtgcatcttggccatctgtgtttcttctttggaggaatgtctgttcagaatttttgcccatgtttaaattggattatttgtctttttttaccctgtgaggctcttgaaagccccagtgcttctacttagaacaacttgtataagacctcaggttaagaaacggctctggaactgggctctgaaggccaacccaggacagaatcagctaggaacttgggaaaggagattttcaaggtcacctgacacttacctccttcttggcttataatgacattgcacttaccccatttagaaatcttaatgtccaagggattcttgtataccgataggaatgcacattaaattattttttttcaaagttaacaattatctaaatattcacattctctctagatgattattatatcaaaaacatgaatttcacaaacaagtgttccccaaacattttaacagttatcttaatcagttaaactattccaaatgaaaacttgatgaaaattataagccaaattatgagttagtatctgctgctgctgctttaattgctaagttgtgtccaactctgcaacctcttggactgtagcccacaaggctcctctgttcatgggatttcccaggcaagaatactgaagtgggttgccatctccttctccaggggatcttcccaacccagggatggaacccaggtctcctgtgttggcaggctttactactgagccaccagggaagtccccatataatagtataaaatgccttaaatatcttaaaaatctgacatacataaatgcaatgattatgaaattttcaatattcagcccacaaaactttgttgcaaaaatgccactgtcatatatctaaattttctcctttattatctctgttcttattcttattttcttttttaaaattggggtagagttgctttacaatgttgtgctagtatctgctgtacaacaaagtgaatcagccacatgtgtacctgtatcccttccctcttgaatctccctcccactcaaccctcatcccatccatctgggtcaccacagaggaccaagctgagctccttctttttcctattgcttttctggggtactggagccctccatttgcccctccagatccactctccccctggtctgccctgggatacacttgtataaaatgcagcaatggagtcctttaccttatgactctggttgggtcctgccagggggaggcatcagccagagattggaggatgggggacactgaggtgaaatcccttcctggagggtctccgtgggttggctacagaccctgctgccgacccctttactctctctggaataatggttcctcccattcccctccaggcctggagctagtaagctctccaccaccctcatgctacagcattcttcctgttggtttcgcttaccctgtccaccccgctaaggatagtccctcttgtgatcctcttcaactgctctgttggagtgtgatgtctctttctttttagacccctgattgataatcaggttacaatttcagttgcctaactttcaaaagcagagtgacctttgctgaccagttaggctgttcaacgcattcatgtgtgctaagtcgattcagtcatgtctgactcttttcaaccatatggaccctagcccagcagccgcctctgtgggattctcaggcaagaatctcatgggattctccaggcaagaatactggagtgggttgccgtgccctcctgcaggggatattcctgacccagggattgaacctgtgtctcttatgtctcctgcattagcaggcaggttctttatccctagtgccacataggaagcccacgataatcagtacagcattatcagttgatagctcagaaccagggacaggagacttggatctgccatccaagggatgtgtccaggcagaagagcctctttatcttttttgcatggactttatttattacatgagaccctgcccgggttattggctctaaatagtttcagttcaattttttttaatgtcctcagtcttgtaattccttgagaaatgatgctgtttggaggtcttatcttgaaagtagaggctgataatggactatgtccaattacataagtctttatgatgcatccaatagaagtcattttgcaactgcttgttccgagaagtgcctggtttggattgactcatcatggtcaattcaatggacctagacaatgatatttttttttaattttaaaattacaaattaaaaaaaaatttgtgttatgattaacattaacaggttaacattgttaacctgatttaacaatgctgtgatccctgggttgggaagatcccctggagaagggaatggctacctacttcagtattcttgcctggagaattccaagaacagaggagtctggcgggatatagtccacggggttgcaaagagtcggtcatgactgaacaactaacacttgagcacttgatagctgattaacaatgtgatggttttaggtgaacagtgaagggactcggacaaacatacatgtatccattttcccccaaactcccctcctatccaagctgccacataacacagcagagttccctgtgcctatgcagtaggtctttgtttcttacccattttaagtatagcagcctgtccatgtccatcccaaactccctaagaagccctttccaccatccttcccccctggtaaccatacatttttttctctaagtctgtgagtctctgttttgtaagttcattttatcacttctttttagactccgcatgtatgggatagacaatgatttttatttctcagtaatcattaagactgacaagaagaggcctttctacctctccgtctgcttaggacctcagggacaactgaagcctccagtgcggcgagtacagtcaaaatgacagggccttttagggtagcctgcctggggcaatttcaggctttcaagagaacaaccatagtgatgagtctcattagctgcccgggggtcaagaagagaaagaccccaagatttcacacttgagaactttctgatacaaactgttatgtgtgagtaggtgtggcagttttactgcttgtactgtgaaaaccaatttgatatttgaatttccccacctgtggacgtgggctgctcaactgggtgcctctaagtcactttcagacacactttcttctacttgctggatcattttctcccaggactgttgtggaaacaagaaacatagcaacaggtgagcatcacccccgggagggctcttcttctagccctttttccagctaatgaagcgaagcacctgctgtttgcccatcgcagagccaggcactttgcagatagttgggttttcaagtacactcccagcactgcccagttagcctgctccctcactgagtgagttcactgtatcactgtcccggagaatcatttcacgtctccttatttctcccccaaactcctctgctccctcctttagctgatgacatttattaggaatggaggagatgccagactttctgaatttccctccctgctccccagtcggcgagcctgcctgtgacgacccatgctctcttctgtctgtcctgcccaaggccaggaccagggctctgggtcctgccaccctctcctgtcctttccaagggcatcctcccagctcccatgggtatcatcagtgtttgcatccagggctcagctgagctggagagggagatcccagctgccagggatcggggtagctgataaagcaacagccccagacgagagtaccagtgaggtttctatctctcacagcgatggcatacacagaggcaccccttccatatcctctggtagaacatgccctggtccaggtcagatggatcagtgggggttgtctcgctgttgagggagcctgaatcaaaggcttctgcagttttgtggatctgggcctggagagaggggagggcgactgggtgcaaggcacggtggccaaccgtacctcaaggctttctcctcctccctcataagggggcctcagcagaggcccctgaagaaggccacagatcaagagacctaggaatgaaggtgccagggctgcaagcacagagcgtcagagcatgatcagccagggacctgagtcccggactgcagctccggtcagagacttcaggcctggctgtcaccagttctcaggtagggagggaacattcctcaggtcctgccaggtaaagccttgtaattgcctattagtcggacccagaagggaaaggcatctggaaatgattttgggaacaacttttgtaaggggtgaggaatggacggctgggcagagggaaccgctgaactcggattcggtcacatctcagccaaaccctcagggagctctgccgaggggtgatacttcagagatgctggagtcgaggcaaggactgggtttgcactcctgcttgaagcagacattggacgtgggcttcccccaagggatgtgggcttcccccgagggaggtgggagcttgcacaaagcccttccctcagctcttctgtcctgacggagggactgggaggtaccccaccatgtctactacatgtcctctgggccactacatctattacacctcctgtccttatcttacctaccttaccagctttcaacacagctgaccagttccttctagaaaaatcctttttcctcaattcccagaatgtcatactcttgtgggtttctttttcttacttgtttgactatttctgctcaggccatttcatgaagctccctttcttctcttgggcattccattcttctggttcttcttctcaagtgttcttgtaccatcttatctttttaaaaaacactacatccttgggactgccctgggggtccagtgggctaggactccatgctcccagtgcagggggccaatccctggtcaggaaatgagatcccacatgctgtagctaagagttcacgtgccgcagctaagacccggtgcaggcaaattacaaaaaaaaaaaaaagagagaaaacaaacagaaaaaaacaaaacagaaacaacgacaacaacaaactatgtctttgatgccaatgttaatgtctttagcccaaaatgatttccgaacttctggctcttacaaccagctaccgacttgtcatcttaacctgattatctcacaggcatctcatactcggcatggccagaatggatgtcttggtttctcagctcactctatagctgctccttctccggctgaccttttccattgaggaaaatggcaccccttctttccacttgtccagagctagaagcctggtctgtagcccagatttctccctttcagttggttgtttctgcctctgagaatccctccgctgctgtcttgcccccacctccagcagaccccgccattatctctagcttggctacagcaagggcctcctgccacttttcccaccccaagccctccactgggcagtccctgagggcagcccacagagtccactgttgactcaggtggaatcccaactcctctgtgctgggcacaagcttctttcctggattcccatcttcttctccaacctcagcccctggtgctcgcggcttcaccctctcgtatttaaggatgtggagtcctggaaaagacctgagtgtggtgtgtggggtcacctcctccagatatcagagtgaactttggttcatttcaagaacattctttggaaggagggcttccctggtcgctcagtggtgaggaatccgcctgctaatgcaggaaacacgggctccatccctggtccaggaagatcccacatgcctcggaacaactgagcccatgtgccacaactattgagcctgtgctctagagcctgggaaccgcaactgctgaagcccaaatgcatcttggagcccctgccctgcaacaagagcagccaccacagtgaaaagccgcacaccacaacgagagagtagcccccacttgctgcaactagagaaaagcccacccagaaacaaagacccagcaagccaaaaataaataaataagattattattactatttttaagagtattttatagtgggagtcacctgcttttcccaaaggaaatctgattttcatggctcagtgcaaaaggtgggtctggggtgctcttggtaggagggtaccagaggatggtggtcctgggctggtgtgtgggctgcaccacagcagagagtctgactatggtccccgagagaccatgacagccccctaggaagcctccttgctggccttttcctttctgtctgggacattcctgtggtcagcttttcttgtttattgctgtggctcttcaacaatttatcacagagctgctggggaacataactcttttatcctgttcacatagacccaatcagtgacagctgcactcaagtggcacaatttatctttttttaagagggaaataccactgaaatcatctccagttatacagataacatggttagcagtcagaggcttgtcttttagttttccaagaaaaccaaagtccgctcagtgagcaccgaggttgtacaccaaaccactcctggccaggcagatccctttcccaggacagcttctaagaggcacttgaaggcactgcaggtggcagagaatttgcaaactgtgtgttcagttgcatttgatttctctgtgttagtaacttgccctgccacaggggcctggggacagccacacataggaaacagctgtctccttcttaaggaatttctcctcctgacggccaagccctaacttccagaaatccaaagtaagatggcttctgattgctgctgcattcaccagggttctctggtaatgccagaatcttacaaaggacaggtgttgtggctctaggagatatcaaggcctctacatgtccgtgggtaatgccagcatgcattaacctatccttgggtactgccaacctccctgcaccccttggcagtttgcagactcatctgtggataacacacccttatttcaagtctaaatgacaatccaatgactggctttttgactcaaaaacatcccccaaatcctcaacttcctcagttaaatgggagaaagcaaacatttattgagagcctttaaatgatgaaatacagtgatgaacaggttagtccttgcccaccagttgcactgataattagagctctgattaagctctacactactggcgagaatacgagatgatttaaaaagttgttgttcagtcactaagttgtgtctgactctttgtgaccccaaggacgggagcacacccagttcctctgtcctccactatctcccagagtttgctcaaattcatgtccattgagtcggtgatgctatctaaccatctctgcatttactttcttcccttaaagttatttcccaatgttcattaattttttttgaaaaattaataacctttaaaaacgttgaagtatagttgatttacaatggtatgttaatttctgctgtgtgaattttatgtttagagcagtattagatccatagcaaagctgtgtggaaaggaccaagttcctgtctacactctgaccccacactagcccagcgtccctcactaccaacgtcccacaccagagggatccgtttgaaacaatcgatgagcctacaatgatgcaacattatcacccaaagttcatagtttacattagagttcactcttggtgttggacacgtacgggttttggcaaatgtgtagtgataggcatccaccatcatcgtatcaggtagaacagttgcactgccctaaaaatgctctgtgctctgctgtccccactccctcccccaccccccaacccctggcaatcaccaacctgtttattgtctccttagttttttgtcttttccagaatgtcatacagttggaattatgcagcttgtgttccctggtggctcagacggtaaagtgtctgcctgcaatgcgggagacctgggtttgatccccgcgtcgggaagatcccctggagaaggaaatggcaatccactctggtactcttgcctggaaaagtccatggacggaggagccttgtagccaccgtcaatggggttgcaaagagtcagacacgactgagcgacttcactcatgcagcttgtagcctttcaaattgtcttctttcaccaagtaatatgtggttaagtttcctccacattttttccatggcttgatggctcatttattcagtgctggataatattccattgtctggttttgtttgtcctgttcaccttctgaaggacatttcagttgcttctaactttgggcagtcatgaataaagctgctattaacattaggtgcacagggttttgtgtgaacataagttttcaactcctttgggtaaataccaaggagtgcaattattagttcattgatttttaaatttcccctgttgtaacccccacagtttcagaaatttcaacccaggaaaacagatgaatcaaacacaattgctcctcttccttccgtctcctctcccctctttcccaccttgttcctcccctcgccttccccccactcctctccttgtagttgtctgcagttgtgccctgttccttggcctgtagttgttggtttgttttggtctctgtatttcagcccaaggagaaggaatttcatgagagcctgagccagggagcagagaccgacagagaagggatacccaggttcaagagcacctctttgcacagtgatgtattctattgatatacactgagccaagttaagtgctgcagggagagaaaagctgtgataggggaggaggatggatgaaggagttctctaaatatagtatctcactcccacttgcccagaatgggatgctctcaacttctcagtttttttttttttttgaagagaataaaccagtgtgggatttgaagaaatgcagctgagtgtgtgcaagcttccctggtggctcagtgataaagaatccacctgcaaagcagaagatgcaggaaactcgagttcaatccctgggttgggaagatcccctagaggctacccgctccagtattcttgcctggagaatcccatggacagaagagcctggtgggctacagtccatggggtcacaaagagtcggatgcaactgaagcctctgagcacacacacacacacacagcttactgtgtgcaagcttcgaggggacttggagggaccaaaaactgctcaacacacctccaactcccccatttacacctttgccccctggtcctgcctcctggggtgcttggcacatctctttccagagcctttctgggggcttctcacaggcagccctttccttagatacataatttccaggtttttccactctgcttagtgccgttcttttattaaattgtcaggttccaaatatgtgtcactatctcttggctctttttgctcttcttccactattgtacatgtgggtttctgcttttttattcagttaatgtcacttgggttgaagttttctgtacttggaggcagattcgacaccttaagtcctcaaggtggtcggttagaaaatgatgcagggtggaggtctgtttgccctcctaggggaaggatagagataaataaatgtgtccaatggggtgggtttcatgacgaggggctcagggctttctgttgaatatgaaattcctgagtggagttttacattgttattcttgcacaaactcaccatactagaaatctctttaaaaaaatatttagaaacttccttggtgatccagtggttagaagtctgccttgcaatgcaagggacacaggtttgattcttagctgggaaagattccacatgccatggggcaagcgagcccaagtgccacaggtactaaagcctgtgctctagagaagccactgcgatgagaagcctgcgcaccgcaatgaggagcagcccctgctcgccacagttagtgaatgcccacgcacagccaaaaataaacaaagttaaataaatacttaaaaatagttatttatttggctgcgctgggtcttagttgcagcatgtgggatttttagttgtggcatgtggggtctagttccccacactgggagcctggagtcttagaccctgggcagccagggaagtccctagacatcacttttgactgcaagatttgtgtctttcaaatcaagcaaaaacatcaaggtacctgtgaggcaacttggcactaaagaattgactcttgtttaacacacaaggaggaaaattcaaagtccccccactggctctgaactggccggcagacactacaaataagttgtacactggacctgggcaagtcagttaacagaggcttaaatggagggcagggaagaaagtgtctgtgtatatgtataaagaaggactggaatcttcccctacccccgcaatataatcgtcacacacctcttacctgcagggtattgcaacagaaggagaaggagggaacaatgccgatgaagacagccttaggactcaggttcgcccagtctcagtccattacctgtcagctgtgggacctggaggactttgtgtgccccctctcactccctctctccactgtagtcacactgcccccttgcctgtcctggctcaggaaaagggaacactcgctgcttcctctgttgggagtgctcttccccagatagctgcagctctttttaaaaaaatttatttattttaattggaggctaattactttacaatattgtggtggtttctgccctacattgacatgaatcagccacgggtatacacgtgtcccccatcccggacacccccctccacctccctccccatcccatccctctgggatgtcccagtacaccggctttgagtgccctgtttcatgcatcgaacctggactgggcatctatttcaaatatggtaatatacatgtttcagtgctgttctcacaaatcatcccaccctcgccttccgctcttgcttcttcactgccttcaggtctcttgttcagatgtcttatcttcactgaggccgtctgtgatctccctcctacctcccagcattccttatccacaaacctcagttttatttcccccccagagcacttcttgcaacctgccatatgactcatttacgtgtctgccattgctgctgcatttctccaaagaaacagaactgataggacatgacatacacacacgtacatctatacacacacaaatgcatgtttatgtgcgtatatacacatacacgtgtgtgtatatatatatagtgcatatgtatttgtatatgctcagtaaatagctgtcgagtggatgaatgagacaaaccatcactccctgagatgaggaggaactcgaggcctggcatggtgcatggtcagtgggcttgtggctgaggtggaactcaacaccagggggccgtgtcagtttctatggctgcataacgagtatccaatataacagcttaaaataacattatgagacttccctgaaggtccagtggttaaaattctgccctcccaatgcagcgggcatgggcttcattcctggctggggaactaagattttgcatgctgcacggtaaggccaaaaacaaacaaacaagcagaaagcaaaaccttactttctcagttctatgagccaggaatccgggaagagcttggctggaccctcagttcagggtctctcaatgtgtcagccagaatgaggctccactagagaagaacccactttttcttttaaatataaatttatttattttaattggaggctaagtggttttgccatacattgacattaatcagccacgggtgtacacgtgttccccatcctgaaccccctcccacctccctccccattccatccctcagggtcatcccagtgtaccagccctgagcaccctgtctcatgcatcaaacctggactggcgatccgtttcacatatgataatatacatgtttcaatgccattctcccaaatcatcccaccctcgccctctctcatagactccaaaagactgttctatacatctgtgtctcttttgctgtctcgcatacagggttatcgttaccatctttctaaattccatatatatgcgttactatactgtattggtgtttttctttctggcttacttcactctgtataataggctccagtttcattcacctcattagaactgattcaaatgcattcttttgaatggctgagtaatattccattgtgtatatgtaccactgctttcttatccattcatttgctgatggacgtctaggttgcttccatgtcctggctattgtaaacagtgctgtgatgaacattggggtacacatgtctctttcaattctggtttcctcggtgtgtatgcccagtagtgggattgctgggtcataaggcagttctatttccagttttttaaggaatctccacactgttctccatagtggctgtactaatttgcattccagccaacagtgtaagagtgttcccttttctccacaccctctccagcatttattgcttgtagacttttggatagcagccattctgacctgcatgaaatggcacctcattgtggttttgatttgcgtttctctgataatgagtgatattgagcatcttttcatgtgtttgttagccatctgtatgtcttctttggagaaatgtctgtttaggcccattttttgattgggttgtttatttttctggaattgagctgcaggagttgcttgtatatttttgaggttaattctttgtcagttgcttcgtttgctgttgttttctcccattctgaaggctgtcttttcaccttgcttatagtttcctttgttgtgcagaagcttttattgaagtatagctgatgtacaatattatatattatataaattattatataattatataaaatgtatataaacaatattattaattatatattttataaattacaagtgtacaatacaatgattcacaatttttaaaggttagatggcacttacagttgttataaaatattggctatattccctgtgtggtggtggtggtttagtcactaagtcatgtccgacccttgcaatcccatgggctgggaagctaccaggctcctctgtccgtgggcttctccaggcaagaatactggagggggctgccatttcctcttccaggggatcttcccaactgagaagtcgaacacaggtctcctgcattgcaggcagattctctacagactgagctacaagggaagcccatattctctgtgtagtataggaaaaatccacttttaagatcacagggttgttggtggaattcagtttccttagggccatttttatctcagaggggcttccctgatggctcagatggtaaagaatctgcctgcaatacaggagacctggatttgattcctggttagggaagatccctggagaagggcatggcaacccattccagtattcttgcctgaagaattccatggacagaggaggctggtgggctacagtccatggggtgtcaaagagttggacacaactgatcaactaacactttcactctcattatctcagagagacacagtagtggtcctgaagagatattttagttgcctgtccaggaactgaacctgggtggcttggatgaaaaaccaggaatcctagctttcagaccaccagggactagaggctagaagcaaaatggccctaggtcttatccctgtttgaaaggaagaatgttttaaggaggcaaagactgtatgctgctgctgctgctaagtcgcttcagtcgtgtccgactctgtgtgaccccagagacggcagtccacgaggctcccccgtccctgggattctccaggcaagaacactggagtgggttgtcatttccttctccaatgcatgtaagtgaaaagtgaaaatgaagtcgctcagtcgtgtctgaccctcagcgaccccatggactgcagccttacaggctcctctgtccatgggattttccaggcaagaatactggagtggagtgccattgccttctccaaagactatataaacaggtacaaagtttagagacacagcactgcatatgggagagcacacaaagaaacagttacttattaagtcagaaacaagacagaactacacccccggagagaaaggctgtgggtgtctggaatgaagaacacagtagagaggaggttaaaccactcacatagggtcagttcttccaggtctttgtttacctttgaccaattatcttgtttcttttcccacctctgacttgtcctaaggtcctcccccatcttcatgagcatctttccccaagatggattccagtgcagaggcctgtgggaagcttgacatcacctattatgggatggcatcctctcctttttgactccccaggagccttcctgtgcgtgtgcagacagggaggttctccttgacctcaggaaagggcatcttatctctttgctttggcagaactcagctcttgccattaactttgtccttggagtgtctgggtgagaaccaagttctagttttactctgtttgaccaacaccagctgtccagtcccggggcccatctatttcctactgcggttaaaccgatgagctcaattccttactggcgagtgcaggtggcttcaggtccttgccacatgggcctttccaccctggcagcttgcttccccaaaggaggcaagctgagcacttctctggtggttcagtggataagaacccgcctgccaaagcaggggacacaggtttgatccctcgtccgggacgattccacatgctgcaggccaactaagcccgtgtgccacaactcctgagcctgtgctgtagagccagggagctgcagtacttaagctcatactccacaacatagagcctgtgctccacaatgagggaagctgcgcctggcaacaaacggcagaccccgcttccgcccctgcgctgcaactacagaaagccacagaaataaatttttttttaaaagggtgcaagctgagaagtcactcgagagagtcagccagcaagacaggaaccaccatcatctgtaacttaaatacagaagcagcatccctttgttagcttctatcgagtcacaggtaccatgcacgctcaggaagagtggattatgcaaaggcggggattactctgaggtgtgagcaccaggaggtggggatcagcggtggccatcccagagtctgcctgtcacaggtgggtaagaacacagactccagagccagaccacctagcctcacttccccattgcgccactcttttcccatgtgatcttaggtgagttccacaacctctctgtgcttgagtctcaacctttgaaaaatgaggcaaacaacagtatccacttcatagggctattgtgagaatgaaattagcatgcggaagtgcttatttatatagctgcacacaagactggctattcactcctgcttcatccgggcaagtacacagtgttgtcctcagagggaaagatgtctcagtggccctaggtttcctgttttggtagaatacctcaatgcagtccagagcctgtcctggccctgatttctcctgctcagagactttaccctcatagctttaaccttctgggcatatttctagtcacaaacccagggcaatcatctagctcatcgagtgccagccagtacgttccaggctgttgaatgaagagctctgatgggtgtggaaactaaggcagtgttccctggtggctcatagggtaaagcgtctgcctgcaatgcgggggacccgggttcaatccctggatcgggaagatcaccaggagaaggaaagggcaatccactctggtactcttgcctggaaaatcccatggacagaggagcctggtagccaccatctatggggtcgcaaagagtcagacactactgagcgacttcactcactcactcactctcacttggctcagacgtgagtcgtgagacaaccaggagacagaacgtgaacatgactcagggaggaaaatcacattgagtctttgttgcacgagacagacttttacgtttcttttacccattttttaccccacaggaagtagattggcttgggcactgtctgaactagggttcagggtatgagacagtttgcagtcactcctcttggctgagcagagggtggaatggcgttcctgtacagtcagctgctcgctcgcccaccctccttcccattttaaacattaaaaagaggttaagctgggcaggttaaaacaatggagcccttcactactctgccggtttcctgtggctgccttgacaaatgaccataaactgagtggtttaaaaagcagagaagttatcctcccgcagttctggagaccagaactctgtgtcgtcaaggctgcgctcctccacagactctcaaagagaaccagttccttccgcctctgatggttctggacatgactcaacttgtggccacatcactccaatctctgcctctgtggttacaccgcttcttgccctcctatccacagaatcccccccaactccacctctcatacaaggacacttgtatgagcatttaaggcccacctggataatccaagacagtgtgtatatcaagaccttgaacttaatcccatctgcaaagatcctttttttccaaatagagtcacatccacagattccaggagttaggacctgggtatctttttaggggactatttttcaggacttcctgtcctgctgcttgagtaatttcactacggaatgattgaatgatggctctgtggacaaagtggagatgacagatcaagacagtacggtactggcacaaagacagaaatatagatccatggaacaaaatagaaagcccagatataaatccatgcacctatggacaccttatctttgacaaaggaggcaagaatatacaatggagaaaagacaatctctttaacaagtggtgctgggaaaactggccaaccacttgtaaaagaatgaaactagaacactttctaacaccatacacaaaaaataaactaaaaatggattaaagatctaaatgtaaggccagaaactacaaaactcctagaggacaacataggcaaaacactctctgacataaatcacagcaggatccttcttctatgacccacctcccagagtattggaaataaaaggaaaaataaacatatgggacctaattaaagttaaaaacttctgcacaacaaaggaaactataagcaaggtgaaaagacagccttcagaatgggagaaaataatagcaaattaagcaactgacaaagaattaatctcaaaaatatacaagcaactcctgcagctcagttccagaaaaataaacgacccaatcaaaaaatgggccaaagacctaaacagacatttctccaaagaagacatacagatggctaacaaacacatgaaaagatgctcaatatcactcattatcagagaaatgcaaatcaaaaccacaatgaggtaccatctcatgcaggtcagaatggctgctatccaaaagtctacaagcaataaatgctggagagggtgtggagaaaaaacaaccctcttacactgttggtgggaatgcaaactagtacagcaactatggagaacagtgtggagattccttaaaaaactggaaatagaactgctttatgatccagcaatcccactgctgggcatacacaccgaggaaaccagaattgaaagagacatgtgtaccccaatgttcatcacagcactgtttacaatagccaggacatggaagcaacctagatgtccatcagcagatgaatggataagaaagcagtggtacatatacacaatggaatattactcagccattcaaaagaatgcatttgaatcagttctaatgaggtgaatgaaactggagcctattatacagagtgaagtaagccagaaagaaaaacaccaatacagtatagtaacgcatatatatggaatttagaatgatggtaacgataaccttgtatgcgagacagcaaaagagacacaggtgtatagaacagtcttttggactctgtgggagagggtgagggtgggatgacttgggagaatggcattgaaacatgtatattatcatatttgaaatgaatcgccagtccaggttcaatgtatgatacgggatgcttggggctggtgtactgggatgaccccgagggatggtatgaggagggaggtgggaggggggttcaggatggggaacacatgtacacctgtggcagattcatgttgatgtatggcaaaaccaatacaatactgtaaagtaattagcctccaaataaaataaatacatttatattaaaaaaaaaagtggagatgacagcccagctatgtaaaagtgagaggtgctgaaatcgtggactgtaggaagggcattttcaaatgttttaggacaaatcaaggctttccccaaggcacagtaggcgaggggacaacccatgaagatgagactagagactattcgctcagtcgtgtccgactctttgcgaccccgtggactgtagcccaccaggctcctctgtctatgggattctccaggcaagaatactgaagtgggttgccatttccttctccaggggatcttcccgacccagggatggaacccaggtctcctggattgcgggcagacgctttaacctctgagccaccagggaagatgaagagaagtgtaactaaatgtttactcactcatgttttttgagctcagacttacaggatccattctaaagattgaaggcaggcacacagctctaggcaagtgttttagagcatccagaaccttctagcaagagtgccagagagactgcagcaccagaatgagccaagaatcttctagagatgagctctgagaaaccacatttgcagcagaaagaggaaggaagggcaggccctctctcatgggtagaaggtgttttgtaaatgaaccaagaggaaacaaaactgttcacctgctatttttgcttctggcctcaccatcaaagcagctcagatgggaaaggacagatggggtgacaatatgctcctgggcaaatcaaagccagagacagacgtagttaaggggcccactggaaggaactctggcttctgaggctggaagacttggcagacttggctgtggaccagtgagaaatacaatgggggtgctggagaggggccagtggagtgagggtgaaggaggctccaggagcccacaagcagattagggtcctcagatcatgaaattctccagtctgacccggattgtagagagttcattaaccatggcccaaagggtaattttgagtctagggagacttgtcggggatggagctatttggttgaaaaatcaataatgcaatttatccagttctgatacatagagtcagctaaccaggtacccctctctctgaatgtttattcttctgtctttttcaaggagaatcaacagtgcgcatctctagagtccactggattcagttcttgggagttcccttcccctgctccattccctaacctagtctgcacatggatcttcttgctgatcccccctcaccccatcattttcccccatgaatatgaatgaggcagatgaagacatggagcccaggaaaggaaatactgacagctttgaaccagccaaaggctggcagcagaaattataaatgggcagagaccacttaaagaagaagtaaggccaagttaacttggagaaggggaataaaagcatgtaaagctttaccaagaaatatttcttgggactcccctgctggtccaggggttaagatattcacctttcagtgcacgggctgtgggtttcatcactggtcagggacctaggatcccacatgccttgtggccaaaaaaaccaaaatatgttacagcaatgaacatcccttgcattgcaactagagagttgcctccacttgccacaactagagaaaagcccgtggagtgatgaagaccaatatagtttaaaaaaacaaacaaacccacaataagataccacctcacacctgtcacacactagtatcaaaaagaaaagaaaaaaaagccactgttgatgaggatgtggcgaaccggctgcaacggacctcgcagaagctggccaagaggagctaccctgcgtccgaggtcaggggcggcagccgggaggagctaccccaggtccaaggagcggtggctgcacgggcgcaggagggctgagagactagtcaatctaatcacactaggaccacagtcttgtctaactcagtgaaactacgccatgccctgtggggccacccaagacaggcaggtcatggtggagaggtccaacagattagactgactagttttctgtgattatggtttcagtgtgtctgccctctgatgccctcttgcaacatctaccatcttacttgggtttctcttaccttgaacgtggggtatctcttcagggcagctccagtaaagcgcagctgctgctccttaccttggatgagggaacacatgtatacccatagcagattcatgttgatgtatggcaaaaccaatacaatattgtaaagtaattagcctccaattaaaataaataaatttatattttaaaaaaaaagtatgaaaaggcaaaatgataggatactgaaagagaaactccccaggtcagtaggtgcccaatgtgctactggagatcagtggagatataactccagaaagaatgaagggatggagccaaagcaaaaacaatacccagctgtgggtgtgactggtgatagaagcaaggtccgatgctataaagagcaatattgcataggaacctggaatgtcaggtccacgaatcaaggcaaattggaagtggtcaaacaggaggtggcaagagtgcatgtcgacattctaggaatcagcgaactgaaatggactggaatgggtgaatttaactcagatgaccattatatctactactgcaggcaggaatccctcagaagaaatggagtagccatcatggtcaacaagagagtccaaaatgcagtacttggatacaatctcaaaaatgacagaatgatctctcttcgtttccaaggcaaaccattcaatatcacagtaatccaagtctatgccccaaccagtaacactgaagaagctgaagttgagcagttctctgaagacctacaagaccttttagaactgacacccaaaaaagatgtccttttcattataggggactggaatgcaaaagtaggaagtcaagaaacacctggagtaacaggcaatttggccttggaatatggaatgaagcagggcaaaggctaatagagttttgccaggagaatgcactggtcatagcaaacaccctcttccaacaacacaagagaagactctacacatggacatcaccagatggtcaacaccgaaatcagattgattatattctttgcagctaaagatggagaagctctatacagtcagcaaaaacaagaccgggagctgactgtggctcagatcatgaactccttattgccaaattcatacttaaattgaagaaagtagggaaaaccactagaccattcaggtatgacctaaactaaatcccttaagattatacagtggaagtgagaaatagatttaagggcctagatctgatagatagagtgcctgatgaactatggaatgaggttcgtgacactgtacaggagacagggatcaagaccatccccatggaaaagaaatgcaaaaaagcaaaatggctgtctggggaggccttacaaatagctgagaaaagaagagaagcgaaaagcaaaggagaaaaggaaagatataagcatctgaattcagagttccaaagaatagcaagaggagataagaaagccttcttcagcaatcaatgcaaagaaatagaggaaaacaacagaatgggaaagactagagatctcttaaagaaaattagagataccaagggaacatttcatgcaaagatgggctcaataaaggacagaaatggtatggacctaacagaagcagaagatactaagaagaggtggcaagaatacacagaagaactatacaaaaaagatcttcacaaccaagataatcacgatggtgtgatcactgacctagagccagacatcctggaatgtgaagtcaagtgggccttagaaagcatcactacgaacaaagctaggggaggtgatggaattccagtggaactatttcaaatcctgaaagatgatgctgtgaaagtgctgcactcaatatgccagcaaatttggaaaactcagcagtggccacaggactggaaaaggtcaattttcattccaatcccaaagaatgctcaaactaccgcacaattgcactcatctcacatgctagtaaagtaatgctcaaaattctccaagtcaggcttcagcaatacgtgaaccgtgaacttccagatgttcaagctggttttagaaaaggccaacatccgctggatcatcgaaaaagcaagagagttccagaaaaacatctatttctgctttattgactatgccaaagcctttgactgtgtggatcacaataaactgtgggaaattctgaaagagatgggaataccagaccacctgacctgcctcttgagaaacctgtatgcaggtcaggaagcaacagttagaactggacatggaacaacagactggttccaaataggaaaaggagtacgtcaaggctgtatattgtcaccctgcttatttaacttctatacagagtacatcatgagaaacactgggctggaagaagcacaagctggaatcaagattgccgggagaaatatcaataacctcagatatgcagatgacaccacccttatggcagaaagtgaagaggaactaaaaagcctcttgatgaaagtgaaagaggagagtgaaaaagttggcttaaagctcaacattcagaaaacgaacatcatggcatctggtcccatcacttcatgggaaatagatggggaaacagtggaaacagtgtcagactttatttttctgggctccaaaatcactgcagatggtgactgcagccatgaaattaaaagacgcttactccttggaaggaaatttatgaccaacccagatagcatattgaaaagcagagacattactttgccaacaaaggttcatctagtcaaggctatggtttttccagtggttgtgtatggatgtgagagttggactgtgaagaaggctgagcaccaaagaatggatgcttttgaactgtggtgttggaaaactcttgagagtcccttggactgcaaggagatccaaccagtccattctgaaggagatcagccctgggatttctttgtaagggttgatgctgaagctgaaactccagtactttggccacctcatgagaagagttgactcattggaaaagactctgatgctgggagggattaggggcaggaggagaaggggacgacagaggatgagatggctggatggcatcactgactcaatggacatgagtttgagtgaattccgggagttggtgatggacagggaggcctggcgtgctgcgattcatggagtcaccaagagtctgacacgactgagcgactgaactgaactgaactgaactgaactgtgtactgttgacaggcaggtaagctggtataggcattatggaaaacagtctggagttttttcaaaaaattacaaatagaactaccatataatacaggaatttcacttctggatattttttccaaagaaaagaaaaacactaatttgaaaagatatacagacctctatgttcaccacagcattatttgtagtcaagatatggaaacaatcagtagatgaatggataaagatggtgtggtaaatatgcaatggaatatcacttatccacagaaggaatgaaatcttaccgtcttttacaacatggatggaactagaggatattaggctaagtaaaatgagttagacaaagacagacaaatgtcgtatgatgtagaatctaaaaaacttaacaaaagaacaaacataataaaaacaagaacaggaatacactcacagatgcagagaacaaagaggtcgtttctagaagggaggggctgtggggatgaataaaatacgtaggggtaactgagagatagaaatttccagttacaaaataaatgagtcttggggatgaaatgcacatcatgggaaatacagtcaataatattgtaataactctgcatggtcatggcagctagatctatcatggtgatcactttgcaatgtatcgaaatattgaatccccatgttgtacacctggaactaacatagcatagtaggtcagttatacttcgattttttaaattaatatttcccccttcttgttctagccttctagaaatactatgtagaactcgtggctaagaaaacaaccttaaggaatgacaacagattgcatttgccaaataaaacaaggaaacaacacacagatggtttctattttttataaccagtggaagcttttgtgactaatgacaatgccaggcggctccaggaagctgtgcaaagaagtgatgctggtgatatcagtacaaagaacacaggaagctctcaggcaacctttaagtcacgtaagcagccctcctcagtcctgccctggcatcctgtgtgttctgcaagctcagcacttaacaagaaataaataacacctttactgagatataattcaggtaccatataattcacccatctaaaatgcaggattcaacagtttttgtatattcataaatacatgatggccatcatcactatcttattgcagaacatttttatcaccccaaaagaggtcccctatccatgagtagccactccccattcttctcctcttccgccccacaaccccagcactttctgtgtcaatggatttgcctattctggacaattcatagaagtggaaagatatcaaacctttgtgaccctttgtgactggcttctctcacttagcatgttttcaaggtttatgtggcatctgggtcaagtggcaaggtcaagtgcatgtagggatactcatttcattgctgcatactattccttgtgtggtttagcacatttcatgtatccagtcatcatctcatggacaagtgggctgtctccactttctgactagtgtgaataacactgctatgcatatttgtgtagagctggtctttgtgtagatctgtagtttcagttcccttggttgtataaccaggactggaattgttaggtcatacgacaattttatgtgtatttctttgatgaactgccagacttttcacagcattggtttttcacagtgttggttattagagtggtgggaccagatccctgtcttccctagcacttaggataacaaaggggctactagatgcttgctgagacttctgctgatttaaagtcctctaatcttcagggcccatcaatccactaaagacctttacagagaaatatttctttttttaaaaagatttttattttttgatgtggaccatttgtaaaatattgaatttgttacaattttgggtttgttttctgaatttctctttctgatagtttgttgttagtgtatagaaatacaatagatttctgtgcattgattttgcatcattgtactgaattcactgatgaggtctagtattttttttggtgccagcctgaggattttctatgtatgatatcatgttgtctgcaaacagccagttttactccttcctctccaactggattccttctattttttttccttatctgattgctgaggcttggaatttcatgttgaatgaaagtggtgagagttggcatacttttcttgttcctaattgcagaggaaatgatttcagcttttcatcattaaatatgatggtagctgtgggtttatcatgtatgacctttataacattgaggtatactccctctacagccaccctggtggctcagcagtaagaatccgcctgccaatgcaggagatgcagatttgatccctgggtcaggaagatcccctgaagaaggaaatgacaacccactccagtattcttgcctgggaattcccatggacagaagagcctggcaggctatagtccatggggttgcaaaagaatcggatgcaacttagtggttacacaacaatattccttctatactcactttgttgacaatttttgtcatgaatggatgttgaattttgtaaaaagctttttctgcatctattgaaatgatatgattattattcttcaacttgctaatgtagtataccatatcgatttgcaggtattgaaacatccctgtatccctggcataaaccccacttggtcttggtgtagaatccttttaatatattgctgaattcatcttgctaatattttgttgaggatttttgcatttatgtttatcagggatgctgctgctgctgctgctaagtcgcttcagtcgtgtctgactctgtgcgaccccatagatggcagcccaccaggctcccctgtccctgggattctccaggcaagaacactagagtaggttgccatttccttctccaatgcatgaaagtaaaaagtgaaagtgaagtcgctcagtcgtgtccgactcttctcgcgaccccatggactgcagcctaccaggctcctccacccatgggattttccaggcaagagtactggagtggggtgccattgccttctccatcatcagggtattgacctttaatttttgtttgtgtggtgtctttgtctggttttggtatttagatgatgctggcctcggagaacgagtttgaaagtgttccttcctcttcaattttgtggactattttgagaaggctaggcattaacacttctttaaatgtttgatagaatttaactttgaagccacctggtcctggacttttgtttgttggaagtttattgattagtgactcagtttcattactggtaatcagttggctcatattttctatttcttactgattcagtcttgggacattgtacatttataggaatttatgtattccttctaggttgtccattttattggcataaaattgtctgtagcaatctcttatgatgccttgcatttctgtggtgttggtcataacttctcttctttcatgcctgggtttactgatttttgccctctctatttttcttgatgagtttgcctaaaggttgaccaattttatcttctcaaagaaaaacttttaaaatgtatctgctaggatctttaatagttctttcctcctactaaggtttctttattctttttctagttcctttaagtataactttaggctgtttatttgagatttttcttgtttcttgaggtaggatttagtgctgtaaatgtccctctttgaatggctttcgcagggtcccataaatttttgatcattggtctctcttttcatttgtctccaagtacctttttttaaaaattgtgatatagttgctttacaatattgtgttagtttctgctggacagtgaaatggatcagctatatgtatccatataccccctccctcttggaccttcctcccaccttcctgccatcccactcatttaggtcatcatagagcgttgagctgagttccctgagccatatagcaggttcccactagctaatctgttttgcacagggcagtgtacatacatcagtcctaatctcccaattcatcaactcccaccccatgtccacccatcagttctctacatctacctctctattcctgccctgcaaataggttcatctgtaccatttttctagattctacatatatatgttaacacacaaatttgttgttctctttctgacttacttcactctgtatgacaggccctaggtctatccacgtctctacaaatgacccgatagccttccttgtccattctatgtatgtaccacatcttctttacctgttcatctgtcgatggacatttaggttgcttccatgtcctggctattgtacatagtgctgcaatgaacattgaggtgcatgtgtctttgtgaattatggttttctcagggtatatgcccagtggtgggatttctgggtcataggtttttgtcatcgatagctgctctgtaaatagttgtaatttgggtgtgtccatgggagtaggtgagctcagggtcttcttactttgctatcttctctctcttttgaaacagaacttttaaaaaacttgttatttatttatttatttatttttaaaacccttaagtttcttcctgggtatttggcccatccttatcacatttctccattttttttcttctaaagagctaaattttaaaagctcacttggtgaaaatattccattatttgtccttgtgctcaaagatggcttttgacattaaaacaaagtttgccactgagggtttgatttctaacccactcttctgctgctaactaaaataagggctaatcttattttggcataagaagcaaaaattggcaacaagaagtaaaaatattaaaaatggggaatagaactgagatactgtaaaattttgtgacttctgatgtgcagttgaaggtgaaaaacaacttcaactcaatttaaaagtagacagaagagaatataacctttttctttacctgatttcactgattttatttttctcttgcctgtgttttggtgttttgttaacttatttaaagagaattagctctatttaatctgcatgtgttaatgagtttctatctgatttgcagtgtagctgtcaggtactcaaggttttggtttacatttttattatctattatttcaacagacccttcttagtagtaggtctgtgtcaagtgccagcatagagaaaggggtagcagcagggagaattacttcccagatgaccagtggtgagaagctcagaagcctggagcagtgctgggaggaaaaattttcggccatgaacatatttccctgagatgttcctaactctgaataatttctgatcttcctgtaaaagcagaaggtgatgggtagaccttttgttgttgttgtttattcactgacttgtgtctgacttcttggtgaccccatgaactgtagcttgccagactcctctgcccatgggatttcccaggcaagaataccagagtgggttgctgtttccatctccaggggatctttctgatccaaggatctaacccacatctcctgcactggtaggtagattctttactgctgagccatctggggagccctggtggaccctttagctgggtattaaagacaagagaacaggaaaacagacaggagtgcaggataacagttaattaccatctctcacaccttctctggcagagcagcgatctgcaccttggttgcacactccctggaaaaaacctgggaaagctttaatacccaggacacctgaatcccaccccagagtgttctaatttagagcaaggcctggcattgacacttctaaagctcgccatgtggctgcaatggcagctatggctgagaaccacaatggtgaggaagaacagggtgactgagaggctgatctggtcttggagagaaggattggaagtcccagtaaggaagcacagtgaactcttctctttttcttccagaagaagctggcaaggggaagcctggggatggggtgacgggaagttggctcaagctggcttctctcagggggtctttcaaacaaacctgacatatgtttctgctatggtgtcttcatgggggcccacaagatgacctgctgaatccctttctgatctcagaattcttggacattttctcaccagtgaggttctcccctccttcttcacttcctagctgcaaagcttgcagccttagcagttagattgcccacatccttctcaagagaactgggctccagagacttggcaaggccacagaatctaccctgagccctggcagggcctgagccacagccctcattacacatgagggttgaactctcagtgcagccctgcagcctgcctcgggctttccttacagggcttcagagggtcctgtgtagggtttgggcccaaagaataagtaagataatcaatgtaaagtatttattacaaagcctggctgctactcccttgatgtcagttgagacaaccagaagtgttgtgggagacacttctgtcccatcctatgagggaaatgtcctgtgggagacaaatctgtcccatcctatgagggaaattaaaatgaaggaagtcttgcagggtggggccagaagtgcctgtaggaaagtgcaattagaagcagaagcaggagagcaggcctctgaccttggttctgaccttcctggacactgtccagattccatgcctgcccgcaagcatagctagtcaggcagcactttagatgagaaaggaagtaggacttggaattcttgaacccctggaggtttggccagtcatgccgggagtttaaagaaatcctatgactcacaagataaaacaaacagcgttgtaaaaatgttaaagtcaatgttaattagaccttgaaatgtttcatcctcagttgttctcctccctgtgttttagtttaaacccaagatatattatacagaaaatagttgtttagatttgctcatatatctaccagtttctttcctgtattactttctttttttcctttcctatatttcttcttacatatcataacttccatctgggaatgttttttttctgcctaaaatatatcccagagatctttctctaaaaaggtcttttgatgtcaaatgtcatcaacttttgtttgtctgattcttttttatctcttttcctgaaagattgaagtcagtatcagtttgtgacctgggattatgagtgggaacccctggaactgcaatttgatgcctcagccacagagtggatgcactgcctgggaccttttcctggttgggattccagattgctgttaaccagggacttcccagtactgttttaaagtctggatgtaggtcagcccaatttggtaatgtatgtgctgttactcttttctattgcttccatttctcttcttttaaagactgtatgttgaaattaagtcaagtgatcttttttagaaaattgaaattgtttgtgtgttacaagtggtttcttttgttaacaaatcctttgaacctaaaacaaaagtaaaactttcagtaaaacacctccccagttaagaaccacttctctagaattgaggtgactctagaaattttatgatacttaacttacccgtacctcagattcatcttattctcctctgaaacaaaacaggatcttaaaacatttcattttcagttgttttcctccctgtattttattttaaacccaggatatattgttattgttttatacagaaaatagttgtttagatttgctcatgtatttaccagtttctttcctgtatttcttcttatgtatcataatttccatctgggaatggtttccttctgtctgaaatatatcccttagatctttatttgatcttttaatgtcaaatatcattgacttttgtttgtctgagtctttattttatcccttttccggaaagatattttttcagtcttataattcaaagttgacaaaaatgttagtgcacttgaaaggtatactaccactctttgacttctttactgctgagatcatcatccataatttaattatcttttctttgaagataatatgccttctctgtttttgaggccctgcagtttcaccttgaattaaatttgcccatttccattcattttggttcactgattcctaagatgtcaatgatcaatcttgccatctcctgcttgacagtctccaatttaccttgattcatgaacctaacatttcaggttcctatgccatattgttctgtatagcatccgactttactttcaccaccaaacacgtccacaactgagtgtcatttctgctttggcccagttgcttcattctttctggagctattagtaattgccctttgctcttccctagtatcacgttggaaaccttccaacataagggacttatctttaggtgtcatatctttttgccttttcatactgttcacagggttcttgtggcaggaatactggagtgggctgccatttcgtcctccagtggaccacgctttgtcagaactcttcactgtgacccgtctgtcttcggtgggcctgcatcacatactcagagcctcactgagttatgcaagcccctttgccacgacaagatgatgactgcagccatgaaatagagacacttgctccttggaaggaaagccatgacaagtctgtgaaagtcactcagtcatgtctgactctttgcgatcccatggactatatagtctgtggaattctccaggccagaataatggaatgggtagctgttcctttcttcaggggaccttcccaacccagggatcgaacccagtctcctgcattgcagatggattctttaccagctgagccaccagggaagccaaagcgtgtgtgttagtcactcagttgtgtctgactctttgggactctatggactgtagctcaccatgctcctctgtccatgggattctccaggcaagaatactagagtgggttgctgttcccttctccaggggatcttcctgacccagggatctaacccgggtcttcagcattgcaggcagattctttaccatctgacccactgagacagcatattaaaaagcatcattttgctgacaaaggtccggatagtgaaagctatggtttttccagtcatcatgagagttggaccataaagctgagtgctaaagaactgatgcttttgaatgtagtactggagaagatttttgagagttccctggactgcaaggagatcaaaccagtcaatcctcaagaaaatcaaccctgaatatttattggaagtaatgatacttaaggtgaagctccaatgctttggtcatgtgatgcaaagagtcaaccattggaaaagaccttgatgcagggcaagactgaaggcaaaaggagaagagggcggcagaggatgagaaagttagatagcattaccaactcaatgaacatgaatttgagcaaactctgggagatagtagaagacagaggagcctggcatgctgcagtccatgggttgcaaagagtcagacacgacttagtaactgaacaacagcaagttttgccctgatgtgatttcttcttctttgtccagctagggatttgttgtcctgagcttgtagactggtgtctttcatcagtcattatcttttcaaatattgaaatactccttttgcctcatcctttctcacctctcctcctgagactgtgattcagttaggtcagttcagtcactcagtcgtgtccgactctttgtgaccccatggactgcaccatgccaggcttccctgtccatcaccaactgtcggagtccacccaaagtcatgtccattgagtcggtgatgccatccaatcatctcatcctctgtcatccccttctcctcccaccttcaatctttcccagcatcagggtcttttcaaatgagtcagttcttcagatcaggtggccaaagtattggagtttcagcttcagcatcagtccttccaatgaacacccaggactgatctcctttaggatggactggttggacttgaagtccaagggacactcaacagtcttttccaacagtctaagggactctcaagagtcttccttgcagtccaagggactctcaagagtcttctccaacaccacggttcaaaacatcaattcttctgcgctcagctttctttatagaccatctctcacatccatacatgactactggaaaacccatagccttgactagacggacctttcttggcaaagtaatatctctgttttttaatatgctgtctaggttggtcataactttccttccaaggagtaagcgtctttttatttcatggctgcagtcaccatctgcagtgattttggagtccaaaaaaataaaaagactgtgattagacatgtaatagatcctctcattctattctcgtatgcgtgtgtgctaagtcgcttcagtcgtatctgactctttgcaaccctatggactgtagcctatcaggctcctctgtccatgggattttccaggcaagattactggcatgggttgccatgcccttctccagggtatcttcccacccagggatcgagtccacgtctcctatgtctcctgcattggcaggcaggttttttaccactagcgccacctgggaagcccctctcatatttcccatccttatgttatgttaatgcattcttgataattacttcagatactcaaatatctgatcaaataccagtgaatgttgctgtgaagatgttatttttaatatgaggttggcatttaaattagaaggctttgagtaaagcaggttactctttatcatgtgagtgggtctcttccaatcagttgaaggccttgagagagaaaaagactgaggtccccagaggaaggagtaattatgtccccatattgcctttggactcagctgaaacatcaacccttccctggtctctggctgtcagtctgctcgactttagacttgccagcctccgcaattccatgagtcaactccctaacaatggaaatgtctcgcttctcattgactctctctgaatcctgactcttatgctcccgtttctgcccaatttacttacattaaaaatttcagttttcctaatttgctgttaagcccattctctgacttttaaatgtcagttacggttgacccttgaacaatgtggcgattagggtgactgaaattcacatataagtttacagtttgctctcatagctgtggttccacaaccactgactgtgtaacattatggtatgtatttaatgaaaaaaatctgtgtataagtggaactgcacgattcgaatctgcattgttcaagcaactgtatcataattttcatttccagagatctatttagcacctcctctaccatgccctcaccccgtcaccaaatccatttgaaacttagtctgcagcagcttttacttattgctcccaattattctctctcgtccttgtgagggaatcatacagtcctgactcttcccagggaaggcgcacacgtccccattctactaacattggacttggccaagcttctggccataggaagtggagggcagtgacatgctccatgttcagcagaagctctgaggacgattgtggtctggtagttctgtccccatttggcaggtccttcagcctagattctagaataaagacatcactgagaaaagaacagaccctcagttgattgccagccacacacaaaatgtgtgagaaagaagtctttgttctccaagccactgggatttgggttcctgggaatcactcggcctcttgtgccatcctgatgctatcaatgcttcttacatttatttgactgcactctgcgtgctctctttccttggaccgtttatgtcggcatctgaagtcttggtggatcaggcccagctgcctgctgtttctgctggcttttccttgtgatgttttcttttgagattataacttctcaggaaagatactactttgcctctccaatcagaaacaacactgaaaccaaaaaggctcacttgcagtccctagtaggctgaataacgacactcaaaggtacccgctgaataacgacaaaggtatcagctgaatcacgacactcaaaggcactgggtcctagtctctggcatctgtgaatgtgacctatttggaaaaggggtctttgcagatgtgattaaattaaagatcttgagttgggtaagttatcctggataattacctgttcagttctgttcagttcagttgctcagtcgtgtccgactctctgtgaccccatgaactgcagcatgccaggcctccctgtccatcaccaactcccggagtttacccaaacccatgtccattgagtcggtgatgcctgggtgggccttaaaatgcaaccacaggtgtctctataataaagagacaggcagagggagagaaccaaacagaggaagaaaaagtgatctgaatacaggcagagatagcagtgatgctgatgcaagccaaagactgctggcatttggaaaaggatggagcagactgtcccctagaacctttgaagacttttctggcaccttgaattcagcctagtgatactgactttggactcctgaagtccagagctgtgagagagtaagtttctgtggctttaagtcaccaacttatgacactttcttatggcagaaaactgatacgggagtgggatgagattcatttattcctagttcacacttacacaggggaggggatgcgctttgggatttcagacttatggggaggtgtcctttccaccccaccttgggtgagcccctagtcttgtcttctgtcccctgagtccttgcaaggggctgaaatcctacagggtttgctgactgccctccagggtgaaaggtggcatattccttccttcctcactagggttcatttgaaatgttgtgattttaaacattatgtccagcattctacttgacttcgtctgagggtcagggaagtggccatactatgggacagggaagcctagatgagattccctaagattgctgacatcttgggggccaaatggtagacatgtccccctcctattcattgtgcagagacatgagcaatatttcctcatgaaagaggcggccaagagacacacggagtcgtgaggagggtggcgaatacgagggcgacttgggcagacatccatcatcagtggtgggagacaggggtgtgtgtgtgtgaggtgtgcaaacagacagcgcatccctcagtgtggctagagaccctggtccctgagatgtctctgattccacccccacaacaccgtattcagggcagggcaggcagtagctcaggggtcagctcctggcccaagagggcctgtgcccttctctgccctcatcttagctgcactgtggtaggaggagacgtgggaggcacagcttcgatccctgggttgggaagatagatcccttggagaaggaaatggcaacccactccagtattcttgcctggagaatcccgtggagggggagcctggcaggctatggtccatggggtcacaaagagtcagacagaactgagcagctgagcatgcacatatgggctttgaattcccccatacttggtaggaggctgttacccttgcggtctccagctagtcagtctcaggcttcagctggtccccttgcagccccccaggacctcccagccctagaggatgtgcgctgctgtcaggccctctgctggggaaccacacagagatggctcactcctgtcgtacccctatgcccacctgggtgggcttttaggactgcaaaatccatatctactctgcttcgctttgggaagcctgctcagggttttagctgcaaccattagcaactcactggctaaaatgagcgtctcagcctgatttgggggagctcacagaatctcaggaagggctggaggaacagccttgggaggcgaaggcaggaacaatgtccaaaccaaacccagcaaagaatctgcctgcggtgtcagagacctggattcaatccctgggtctggaagatcccctacgaaagggaatggcaacctgctccagtattcttgcctggagaatcccgtggacagaggagcctggtggcctacagtccatagggtcgtaaagagttggatacaactgatcgactaaccctttcaacacttaactgctggtgccgagtctcccaggctactggatgcttccactggaaccctggcctctactgctgccctgcacgcccctccccgtctcccaactcaaagcccggcagctagggggctgcaaaggagcaggtggcattttaagcccctaaaaagggagaagggttcacactttccaagatggagattcctgagacacgtgaagggctttaggcaaggactggatgaataatgggcaataaaggaatattcctttccttctctcccaagtcagagacattcatgtgcatagaacttgatggccttcctgtcacgcctcctttagcgatgatgagctgaactggggaagggaactgacttctcccctgtcgttaagactagctccaaacccgagtcaggggctgagaaaccagaacgtggtgattgctccctcacatcactgaacgtagtttaaaaacactgaacaggtcaacaaacttttgaccttccccccatgttgtttccatttaaaaaaaatgtcaaattacttcaaaaaatgttttttttattttggggaactttgattgagcaacctggcccagaggaaggggcatttgttgctgacctaggtttgtgaagtcagtcatacccatgagatgatgagttaccatttattgagtgaatgctatgtgatggcaccggggtgggcatttttcactgagtgtcactaatccttgggtcttttcatcttcatgtacagatgaggaaactgttaagcgtctgaggtggaattcaaagctgatgcatgcgtgctcagctgctcagttctgtctgactctttgtgaccccatggactgtagcctgccaggctctcctctccatgggattctccaggcaagaatactggagtgggttgccatttcctcctccaggggatcttcccgacccagggatcgaacttgcgtctcctgcatctctggcattgatgggcgggttctttaccacggagccacctggcaagcctggaattcaaagctgagggccttctattttctgaagcttcccagttgctgttgggcccctgtgcctggcacagtccctggctgactgccaagcggggactgaggaatatccactgaatgagtcaacagtaaagacagcatatgagacctggttcactctaacagccacacagatggagtgccatttaacgcacgtggactaaatagagaataaggctttaattgagcaccagcattatacgaaacgtgtctgcatagaaaaataaacccagtccaagtgtccctgagaatccagagtctgcactctgtacagtgcttggtgatagcgacttctgagtcgacgccatttctcccgtcagaatgtcggcactctcagattccacggtgccttggtctttcttcctcattttatatatttttgtttctaaccatttaaaacttttttttttggtggttttctttttttgccacatggcttgtgaggtctgagttccgtgaccagggactgaacctcggccctcggctgtgaaagcatggagtcctaaccactggacctgctggggaattccctaaaacctttttatattagtgaatacacaggagaatcatacctgagaatcatatctctggtggccaacctcaacctttgttttttttttttctggccacatcacgtgatatgtgggatcttagtttttcaaccaaggatggaacctgtgccccctgcattggaagcatggagtcttttaaccactgggatggaccatcagggaaatcacagtggccaacttttttttcaaatcattaaggcctctaaaaagtggcaagttcccaaggttttgccacatgagcatttggagtccagctccttggcagtgtggacgctgccccggcgtctgcgtgagctctccatctggggtttactcaggcggtctcggcccgccctggctggctgctctgactgcccttggggggagacaggacaaggagggggtcactgcgcccggctgagtgtgctccctccttggacatcagctggaaggacccctgcccacgtcaggtcgtgagaccgcagccggccccagggttcagcttgcagctttcagacacttctgtgatgacgctcagtttgtcaaagacttcattctcatcagacagtgggaaggagaataagagaagagtactgtgatgagggtggctcataaactgcagggagggaaaaaaaaaaaaaagagttaattaacaaattttcccacttctttttctgggctcacaattttctacagaactcctggctggaaaatgctgtttttaaaaaaatgtaataagagtatgacagttcctcacaaaattaaaaccagaattaccgtatgaaccagcaattccacttctgggtatacacccgagagaactgaaagcggtgtctcagagagatacattaatacatccccctgtcttcagagtccataattcacgagagccaaaggtgggagtgggccaagtgcccacccacacatacgtgtgtgcgctcagtcgcttcagttgtgcccggctctgtgcgaccccacgggctgcagcccgcaggctcctctgtccaaggggattctccaggcaagaacactggagtgggctgccatgccctcctccaggggatcttcgcatggatcagtttcttcctagatatcaaacccacgtctcctgggtctctcgcactggcacgtggattctttaccacctgggaaaccccatccatgtatgactggacagatattgtgttggccaaacatttgtttgggtttttgttatgtcttctagaaaaatccaaacaaaccttttggccaacccgacagaatgtagtctatccatataatgcaaatttttcagcctcaaaatgtaatgaagttctgatacataccacattgtcgaggaaccttatgctaggtgaaatacgccagacacacgaggacaaacagggcatgactccacttacatgaggtacttagactaggccaattcacagacagagagtaacggtggtggccagcggctgggggagaagggagggggagacttctgtttagcggatccggtttgttttgtgagacgaaagaggttctgaggatggagggtgaggagggttgcacaacaatgtctatttactcaataccactgaagtgtacgctgaaaactgcatatggtggcgaattttgcattatgcgtgttttaccacaatttaaaaaattcgacaataaatctgcacctcctttgcttagtgatcacaggtcctcctctgacagttcctcttgtaaacccggagggagacttagggatggtcccgatgctgcctggggcatccttgcctcgaggaagccagcttgggatacttgtgccttggaataagtcactctcctatgctccccagcaccccgagtgtccctctgttcagccttcagccctgtgccattcagtatggcagccaccagccacatggaatgtggccggtctgactctacgtgtgctgagaggtaaaacacacaccagattttgaggactttgtatgaaaaaaaaagaatgtagatgtttcgacaaatgaaaaaaattactgattccatgttgaaatgatattttggatatattgtgttgcataaaatgtattattaatattaatttcagctgttcctttctgtttgtaatttactaattggagtctaattgccttacaatgtggtgttagtttctgctgtacagtgaagtgaatcagctatatgtatacatacatacatatatgtatcttcccttccctcttgggcctccttcccctccccatcctatccacctacgtcatcgcagagcctgagttgagctccttgcgcttacagcttgttcctgcgagctatctgttgttgttttgtgttttgctttggttttcttggccatgcctcatgtcatgcaggatcttagttccccgaccaaggatgggatctgtgtcccctgcagtagaagtatggagtcctaactactggactaccaaggaagtcccctgctccttttcacttttgacaaaactgtgcatgcatgcttagtggctcagttcagttcagtcactcagtcgtgtccgactctttgcgaccccatggactgcagcatgccaggcctccctgtccatcaccacctcctggagtttacccaaacccatgtacattgagtcggtgatgccatccagccaggtcatcctctgttgtccccttctcctcctgccttcagtctttcccagcctcagtgtcttttccagtgagtcggttcttcaaatcatgtaaccaaaatattgtgatttcagcttcagcatcagtccttccaatgaatattcaggactgatctcctttaggatggactggttggatctccttgcagtccaagggactctcaagagtcttctccaacaccacagttcaaaagcttcaattctttggcattccactttctttatggttcaactctcacatccatccatgaccactggaaaaaccatagccttgactagatggacctttgttggccaagtaatgtctctgcttttcaatatgctttctaggttggtcataactttttggtcataacttttcttccaaggagcaagcgtcttttaatttcatggctgcagtcaccatctgcagtaattttggagccaaaaatataaagtctgtcactgtttccactgtttccccatctatttgccatgaagtgatgggaccagatgccatgatcttagttttctgaatgctgagttttaagccaactttttcactctgctctttcactttcatcaagaggctctttagttcttctttactttctgccataaataagggtggtatcatctgtgtatctaaggttattgatatttctcccagcaatcttgattccagtgtgtgcttcattcagcccagcatttcgcatgatgtgctctgcatattaagttaaataagcagggtgacaatatacagccttaacgtactccttttcctatttggaaccagtctgttgttccatatccagttctgtctgttgcttcctgacctgcatacaggtttctcaagaggcaggtcaggtggtctggtattcccatctctttcagaattttccatcgtttgttgtgatccacacagtcaaaggctttagcataatcaataaagcagaagtagatggttttctggaactctcttgctttttcgatgatccagtggatgttggcagtttgatctctggttcctctgcctttcctaaatctagcttgagtatctggaagttcacagttcacctactgttgaagcctggcttggagaattctgagcattacttagctagcgtgtgagatgagtgcaattgtgcggtagtttgagcattctttggcattgcccttctttgggattggaatggaaactgaccttttccagtcctgtggccactgctgagttttccaaatttgctggcatattgagtgcagcactttaacagcatcatcttttaggatgtgaaatagctcaactggaattccatcacctctactagctttgttcatagtgatgcttcctaaggcccacttgccttcgcattccagggtgtctggctttagtgagtgatcacaccattgtggttatctgggtcatcaagatcttttttgtatagttctgtgtattcttgccacctcttcttaatatcgtctgcttttgttgggtccatatcacttctctcctttattgtgcccatctttgcatgaaatgttcccttgcatttagaaattagaaaatctctaattttcctgaagagatctctcattctattctttcccattctattgttttcctctatttctttgtattgattagtgaggaaggctttcttttcttgccttgctattctttggacctctgcattcaaatgtgtatatctttcatttacaccgttgcctttagcttctcttcttttctccttattgccaaattcagacttaaattgaagaaagtagggaaaaccactagaccattcaggtaggacctaaatcaaaccccttacgattatacagaggaagtgacaaatagattcaagggattagatctgatagagtgcctgaagaactatggacagaggttcatgacattatacaggaggtagggatcaagaccatccccaagaaaaagaaatgcaaaaaggcaaaatggttgtctgaggaggccttacaaacagctgagaaaagaagagaagctaaaggcaaaggttatataagtatgtaatatcttggggctcccgtggtggctcataggtaaagaatctgcctgccaatacaggagacacaggttagatccctgggttgggaagatcctctggagaaggaaacagcaaccttctccattattttgcgtggaaaatcccatggacagaagagcctggcaagctacagtccacggggttgcaaaagagttggacacgacttagtgactaaagaccaacaaccgcacactacctcagtcttggttacaaagcctaaaacagttattatcccagagagggacgttcccacgagaggacacattagggattccatcaaactataagttatagctgccaccttctcacgtcaggatccttgtgccaaaaaattagccggccaggaatgcagtcgggagtcactacttgggtcttcaggaggagaaaaggctgctgctacatgatggggcccggggggaggggcgactcctgcccaattctcatggcacgtggagaagcacaagagccggggtctctggtgtcctgtgaccaggggctcagtcctcgcagagtggagggtctgaatcgcccctggcaggtcggcagcggctggtcaggcgagaagagacagcagagcagggaggccacgggtgtcacttgcgcctttgggagcagctgcagtggcggggctggcccctgttcccttaaccttcctcctgtaaccttccccgggggggagatcgactcggctcttagagaagctgcacccctgggtcctagcggtttacgtgtaggctggagtggacgctgcgatgtaccaccctcaccccaatctttaggaagtaggggcttgctccctcggctgctgggagtggcggtccccccacccccctaccctgggaggttccctgagctgaaggaactgctccatccgaactgtgcctccttcctgggggagcccacacccagcccaggggagacgcgggcttcacttcacatttcctttcacttcatttctaatgagaatataagatttcatttcttaaagccacttctgtcctacaggctctatccaggtacattctttcttctacccaaacattttgaaagtagctttcctgtagttcagttggtaaaaaatccacctgcaatgcaggagaccccggttcaattcctgggttgggcagatcccctggagaagggataaggctacctactccagtattcttgggcttccctggtggctcagctggtaaagaatctgcctgcaatgtgagagacctgggttccatccctggattgggaagatcccctggagaagggaaaggctacccactccagtattctggcctggagaattctatgactgtatagtccatggggtcacaaagagttggacatgactgagcaactttcacgttccttttttttttgtttttccacttttctggaggaaaaaaaagaactgctttcctaaagcctgggacacacatcctgtaatttcagtcgctctcagacactccccactctgacactgctcctgcccctccactgtccctggctgttctcccctctttcccatcttttctgctctgagcttggcttggtccctttctgctccgggaccagccccttggctctctgatgacttggggctccaggcatggaaggtcagggaaggaacaaacatccaggctggagggagggcttttaggaacaaaacctctgccccccgccccctccctatagagctgttccctgagctcagacttatctggaagggcaccaggaacgggacctgcacgcaagacttgtgtcatcctccaagaaaccacgccgggctgagttaggcggctctgactgtaaaggtcagcgtcttcttacgcacccacatctggctccatgccgctgcctacctctttcaggtgctgcggaagagaattcctcggggggaaggcgtgccttgccttcctgtaaacacaccgcagcaggaagaagcagccgagcagtagcaggagagcggcgcacacggaggctgccaggacgctggccaccatccaggacggggtggtttctgcaggaataaagggctgggtcatatttgcgtcatgcccggcttgggtgacggtgaccttaatgctcttttcaccatcatcttctaatggtaaccccttaccgctggggcggggctggggtggagggcacaggtgtgtctcagaaggaaacacagcagctatttgaggatctggaggttttcaagtctcaccctttcctaccatcctccaagttgggtttctggggcatgaatgctgatatgccccaaaaagcagcagctgcacgaactctgatccccattatctacccacaggggagctatcagctccatgttctgctgttccatcagcagaaaatggggctccctgggctccagagccccagtgacacacacgtgctacagcattttgtactgagaactgcacaggggacccccctgactacctgtgcgcagagacctcccctaacgctagtgcggtgcccagcagcctaaagctgatctctgggtggccccctccctccccagcacctctgggagctcctgtctggaaaaacccgaggctaccgaaagaatccacctttgttctaccaactcctgacgttcctttcttagtgcgtttcctaaaaagctcagggctggaaagccttccgctctcccagtgagacctaaattagctcctacaatccaggagtgtctttctcaaggatctggaagccaatcctttgacatgtcatcatcaggatggagcgtcgtgacagaggaagagtccctgtctcagtcccagtgggaagaacaccgcaggtggtaaaagcccgttagcagcagacgcagagaacagcctaagtgcattaccaccaccccatgcatccacccagtttcggtcatctgtcacttctgtgaccccgacctcttttcgtcccgattcccagttctgtctttaaaatgccccatcagctctttcccctcctccagtcacgaaatgaatcaaacctgtttttaccaccttaactgatgtccagctgtatcttggactgtctccagggagtcaccctgggtggcccagctcccctcatttagcaccaggcccctttgccaactgccctcctggcctccctgtgaccggccctgtcagccagcaccaccctcctgatgcaaactgaaagcaaactgaaagcatttggtactgagagaggccaggagaatgaaccctgccctggaagagcaggtccctctatggggattgcagcaaagtgtcaactcttacttccccagggcagatcaaagaaccctgatgggcacacagtcttggagccacctggacggcaggccccctactggcctctcccagcacttggcacactgcgtggccatagacactccttaaacatctagtgaatggtgagggcacccgtcatggggaagaggctggaagggcctgctgccctctcttgcactgtgattaacacgggcagtgaccttgcagcctgtccaggatgtgccctggccgagttcagggaactcactccttatccctgcaccctatgaattctcatttcagttactagaatcaagtggtgatgcctttagcagattcaactcagatgggttttctgggtggatacagggtcgtggggcaagggaactggttggggtggcccccaggctttacgagagctgatgatggtaggtcagcttgcgatctgacgtcccagctctggaggaagttccaggacccatctactcatctctctatctttccacttaatatttctgtggctctctaatttgccatacatcagaattactcattaaatattcattaaacattgactcctgggccccaccctggcacagttggtgacactgtgatgattcccctgggggcagctcctgggtctccttgggcctccaacccagaggtttcagcatcttacacaggacattattccgtgggtacaatcggttgatggtaataaaatttaaaagatgcttttgtgacttaccaagaagggggaatggggaaggagagaaagttagaaagacagttaagtcgttcagtcatgtccgactctttgcgacccctggcctgtagcccaccaggctccgctgtccatgggattctccaggtaagaatactggagtgggttgccatttccttctccaggggatattcccgacccagggattgaacccagggaaggagaggggatactgctttacacagactgtgacttgcggaagaatctggtcctgaactgaactagtaaccaacactccctgtgtgaagctcttaacttgcctcagtctggctggtcatgcctcaggtgagctcccttttcctgtctcaccctcgggcaagtcttgccttggcttctgtatgggatcaatctgtaggcatgggtggagatgttacttcctgttatttactggttgagctgacttccggcaagttacttcatctctgaaccttcaccttccttctgggcaaagggaaaagaacctttccacactttcactgaaaacttgtgaggtttcaacagaactacatttaaacaaacaaacaaacaaaaccctaaactgatgtttgacaaaagcaggttttcagtcggctattttcttttataaaatgtctggattttgttagttaatgagtgatcgtttagagttagaagatatttgaaatacttttctttttggtccaagtgtgtgcctcatgccatgtttcatgacataagccttaagtaatatttaaaggtgtgattttatttttaaaaaatttttatttatttggctgtcaggtattagttgcagggctctagagtacatgggctcagtagttgtagctcaagggctaagctgccctgtagcacgtgggatcctcattccccaaccagggatcaaacctgcattgcctgaaatggaaggtggatttttaaccactggagcatcagggaagtccctaaaagtatgatgtgaataatgtccttattaataacagtaatgacacctaacctgtattgcaggctgactctgtgcctggcactgtcctgggtgacacctttgattactctcatcttgtagatgagtcaacggaggcagtgggcagttcaggatctgccccaagtcactcactgtgttggaattcacagcagggaaggatgggacacggaaccaggcacgtactcaggcctggagaaagcagttggcaggtgtttaagaggaaagagcgaagatcccaaagtcaggattctagtgatttaaacgtgatgggtgctcccagggtacagaattctcattcaggtacaaatgattcacgagtggaataaaaaggtaggcttctgggagttctctggtgggccagtgggtaggactctgcgctttcactgccaagagcctgggttcaatccctggttggggaacgaagatcccacaagccttgcggggcagccaaaaaaaaagggttttttttttggtttttattaaggcaggcttttgttatttagaggcacttgctgagaggctcagccacaaggtggaacacaggcagggggaacttagccttggacagcagtgcctcggcactagctggaggctacagaaaaaacagagaggcagggaatcccctctagagagacagcaagactccatcttctatgcggctctgtcatcctgagaaaccgtgcttaatattactgcagaatacttttggatgacactggaaaagtcacgtgaccaggtgagatgagagatttctggatttgggcaagtaactttgttcaactagaaaacaagggaaagaaacttcaatcaggagactccaggctggtaagcctgattcagtgtccagaaaaaaatacaaaaatggattgttaagtggctacttgttgtttgttgtttagtcactaagttgtgtccgactcttttgtgaccctttggactatggcccaccaggctcctctgttcatgggatgtcccaggcaagaataactggagcaggttgccatttccttctcccaggatcttcccaacccagggatcaaacatgcgtctcttgcactggcaggcagattgtttatcactgagccactagggaaggctgaaattatggcaaagttgtgcttgactctttgagattctatggactgcagcatgctaggtttccctgtctttccctatctcccagaatttgctcaaattcatgttcactgacttggggatgttatctaatcatcacatcctctgcagtgccttctcttcctgcccttaatctttcccaccatcagggtcttttccaatgagtcagctcttggcatcaggtggccaaagcattggagttttggcttcagaatcagtccttctaataaatagtcagggttaatttcctttaggattgactggttggatctccttgcagtccaagggactctcaagagtcttcacaggcaccataatttagaagcatcaattctttggcactcagccttctttatggtccaattctcacatccatacatgactactgggaaaaaccatagctttgactatccagacctttgttggcaagctaatgtttctgctttttaatatgttgtctaggtttgtcatagcttttcttccaaggagctgtgctgcgttgtgcttaaatgctcagtcatgtttgactctttgtgaccccatggactgtagctggctaggctcctctgtccatggggattctccaggcaaaaatacggagtgggttgccatgccctcctccaggggttctttccaacccaggtctcttgcactgcaggcggattctttaccatctaaaccaccagggaggcgtcttttaaattcatggctgcagtcaccatctgcagtgattttggagcccaagaaaataaaatctgtcattgtttccactttttccccatccatttgccatgaagtgatgggactggatgccgtgatcttagttttctgaaggctgagtttcaagccagctttttccattttcctcttttaccctcataaagaggctctgtggtttctcttcactttctgtcattagagtgatatcatctgcatatctgaggttgttgatacttctcccagaaatcttgattcctgcttgtgattcatctagcctagcatttcacatgatatactctgcatataaattaaagaagcagggtgacaatatacagtcttgacatgcttcttccccaattttgaaccagttagttgttccatgtctggttctaactgctgcttcttgatcagcatacacgtttctcaggtaaggtggtccagtattcccatctcttgaagaattttccacagtttgttgtgatccacacagtcaaaggctttgcatagtcagtgaagtagatgtttttctgaaattcccttgctttctctatgatccaatgtatgctggcaatttgatctctggttcgtctgctttatctaaacccagcttgtacatctggaaattcttggttcgcatactgctgaagtctagcttgaaggattttgagcataaccttactggggtgtgaaatgaacacaactgtacagtagctggaacattctttggcattgtccttctttgggactggaatgaaaactcaccttttccagtcctgtggccactgctgacttttccaaatttgctaacatattgagtgcagcactttcacagcatcatcttttaggatttgaaacagctcggctggaattctatcacctccactagctttgttagtagtaaagcttcctaaggcccactcgacttcacactccaggatgtctggctttaggtgagcgatcacaccatcgtggttatcccagtcatgaagatcttttttgtacaggtcttctatgtattcttgccacctcttcttcatctcttctgcttctgtgaggtccttgctgtttctgtcctttactgtgcccatccttgcatgaaatattcccttgatatctccaattttcttgaatatatatcttgtctttcccattctattgtgggcttgtttttctcaagctgtgttcttggaaatgctccttctcaaaaaaggtactgaaagatcaaatatgctaaaaatgctcatatatagagtgtttttttgagagggagatggggtgagccttcgtgtccaggcccatctgaccacagggctcttgttctgagaaacgccccataagcgctcatgggacacagctgggacaataagcacgtggcacggggtgttgatttcagctgagatttgccaaaaagtctttcacggtgactctgcggacagtcaaacacaacagcttacaaaacagtccagtgtgttcctatggattggtgaccattaagtagttaaggggtctagagaaaggcatatcctggacacaccaacggtttaaacaacaaactggtaaagatcctgaagctcttcctagcagatcagtttttctttgataagacaacacaaaattgggcaagaaatacgtccaatgacaaaaacccccattcgggaagaacttgataagctgaagtgatgaagtatcatgacggcagcaacacagcggcctcgggactgcagtgacacagaagatggaaagttttcccctctctctggaggaaatatttttttttgcatatggatactcagttgctgggcatcattcttgttgctttttgttttcagaccttttattttatattggagtatagctaattattggcttccttggtggctctgacggtaaagcatctgcctgcaattcgagagacctgggttcgattcctggattgggaagataccctggagaaggaaacggcaccccactcctgcactctcgcctggaaaatcccatggacggaggagcctgataggctacagtccatggggtcgcaaagagtcggacacgactgaggacttcactttcactttcatagccaattaacaatgttgtgacagtttcagctgcacaggtcagcgacccaaccgtacaaatacaggcttccagtctccctcaaactctagacggaattcttttattacaattgctctcctctgtattctgcaatccccagatcactgctttgctttccaaagggactccataaatgaaaagagccaggatcagacctccttgtatgcatctgagctggtggatcagtcagagatgaactggagtttgagctgggtgataatctccaaggagcctttcagccggcacactcggtggaagtctctaaagccacttaagatgctcagaggagggaattccctggcggcccaggggttaggactctgttctgctgtaggagacacgggttcagtccctgtttggggaatgcagatttcacaagccttgcagcatggggccccaccaccattacccacatgtaaaaaaaaaaggagggtgctcagagacacagagctgcagatggtgcgtctcaagactcaccgtcaatggttgtttgctcgcagacaggctcactccattctccagcttttttccgatcagaaagaaaccctcgaacttgaacacaataagttgtctgtgactcaagatttcggaggaactcgaagtcatactgaccagaaattgaaaactagtaacagagaaaaaattaagaacatgcctcagcagtgaagggacatcatttcccatcgccccaccccaccccgccacctgccacttactggttataatctttacttcaggctcaaaataggaggataaaggaagcagatgctcctcccacgtcacctcaggtgaccctgagatcattttaagtggggaggagggggaagggaaaggactgaccatggtcctggcaaactgctttattccctgaattccctagtttaaatgatatgcaaaccatcccgcattctttttttctttttttaaagataaaccagttgtatgggttgaattttgtcctcccaaattcttacatcaaaatcctaaaaccctagtactttcaaaagtgatttggttagacagaaggtctttttagatgtaatcaacgtaaatgaggttattagcatgggccccaatccagtatgactggtgtccttaaaagaagaggacatttagacacagacaggcacacagaatgccacataaagatgaaggcagggattgggctgatgcctctatatactaaaggatccaaaattggccagcacccaccaggagctgggtgggaggcctggaacagatccttcctcttggtccttagaaggaaccaatcctgctgacaccttgatcttggacttctagccttcagaacctcaagacgacacatttctattgcttcatccatccagtttatggtacttggttactgcagccctggcaaatgaacacaccagccatctacagtaagacccaatgtgatttctggccctagctgcctggggttctcctctgaatcacttctccattcacgcacctgggctgccctccccgagcggctcatctcacctcaaggatatacaccatagactgcctctggtggggccatcccagactcatcttagtttaatttgaatatatcataattgatgacatatttctgaatttgagaaaccaaaatagtgttgcagggaagaaaatctgactccacattgcatctgtttctttgactttaacctttgcttcctacgaggatactatttgtttttgttcactacgagcatactatttatacacaatggcctgcctgcgggtaccctgcccctctcctttactattaaaccaaagtgtctttctttattcaggatgctgtccacctgtgaacagctgactataggaaggaagaaattaacacacaccctcccccaacccctccaaggttggccattccaggagatacttgcaagattaatagcctttttacttcctcacttcctctccctctctactctataaaagaacctggcgtccagagcctgataagaagtttatttttgagagattagtctgccatcttctcggttttctggtttttcaaataaagtcatttttccttggctcaatatcttgtctctgatttactggcgtgttgtgtggtgagcagagtgagcatggagttggtaacaatagtttccagcaaaataaagggaattaaaagagtacatacatacagcctgtatttccagcacggttacaaattccttataaaagggccttatgaaaaatttgccatgtgaataggagtttcaatagaaactgaacaaagactctgtttttactttagtaattgtttacttttctttgggtgctgggtttgctgatagcttgtctctattcttttgttgtattagaagctgagctcactgaaggcaagaactggattttaccaattgaaacatgaagagtatagtataacttctaatgattaaaaacagaaataaaaacaaaaatccctggctttcatttccagaaacccaattatctcgaaaacctttcaatgcatttttttcaaggctaaactcagaggctgacacgtcaaaagtagatagagaagagatgtgaagtcttttttcttttttaacttctggacagcttcttctttttcttttttttttaaaaagatttatttatatttttgctgtgatggtctttgttgctgtgctcaggctttctctagttctggcaagctggggttactctgcgttgaggtgaatgggcttctcaccgcagtggcttctctcgtggagcacaggctccaggacacacgggcttcaggagttgtggcaaatggtttagttgctccacagcacgtggggtcttcctggaccagggatggaacccatatcctttgcattgcaaggccgattcttcaccactggaccaccagggaagccccaacttctggttttatctccctgctgtctcccgccaggaagaaagaatttctagaagcttttaatgtttttagctcagggacccgaactggtggcactctctcagagacacctgcattctaaaagggaaccatttaatcctatttctttcaggctgctgtaaatagaatgcagaagactgggtggcttattgacacacatttctttcccacagctctggatactgggaagtccaagatgaaagcaccagcagatctggcctctcaggaggttcctggttcataactaggttttcttgctgagtcctccccaagaggtggaaggggtgagggagctctctggggcctcctttcaaagggtgctaagaccattcacaagggctccatctttatgatctacctcctaacaccatcacactggggattggagttcaacacgtgaattaccagaagggtgagggtggggataggggtaaagagacaaaacactgagttgatagcaagataaactggcaaaggtggccctgcaggcgctggtgagagacgtgcactggggagcatgcagcctttccagtactctgtgtgttcacaccgaagtcttcataccccaggcagaaggaagggacaaacgtgtaaccagatgccagtcctgagggcatattctagataagaagctaaagatagactaggtttgcacttcgtgcctggggcaggaggcactcaggccctgggtaactgtggaatctgattcttaggatggggaacacatgtacacccccggctgattcatgtcaatgtatggcaaaaaccactacaatattgtaaagtaattagcctccaattaaaaaaaaaaaaaaaaaatcacagtaggctgctagctccaggagttatctttgtatctcagagtttagcagggacccctgtgttcaacaagtgatcataaaacttattgttctgtattgcttcctaggtacatgaaatcccagggtcttgattataagcaaaatcatctttcctgtgaagaaggcagatatcctgtatcatttaacaaagcatttaaaaaaatcgaagtgtagtttatacacaatatcttaatggtttcaggtgtacaacagtgtgatctgatatttgtatacgttatgaattgatcacaacggagccttttttgggggaaattaacttgagattttgggggactacagagtatgtagatataaatttaattacatcattcctcggacaatacaggattcccaggtagctcagctggtaaagaatctgcctgcaattcagcagaccccgtttcgattcctggcaagggttgggaagatccactggataaaggataggctacccacaccagtattcttgggcttcccttgtggctcagctggtaaagaatccgcctgcaatgcaggagacctgggtttgatctctgggttgggaagattccctggagaagggaaaggctacccactccattattctggcctggagaattccatggactatatagtcatgaggttgcaaagtgtcggacatgactgagtgactctcacttcagataatacatatgggtgacctgttcttgccaaatgcatgagcattagtgatttaatgtagaggaggtaacatatatgtaacataacttacataacatatatgtaagtcagtttaggaccagaaatgccatttggctcagaagcactgaaagaattaaaggtgatcaaagatgaatgaaaacagcattttaacctgtctacacaaggggaagggaatctcacatgttgacccataacacattgttcaggcaatgggacacgtttacctttctttttactttttttcatatgtcattaaattcctcaacaactctgtgaagtaagttattgctgctgcttagatgcatcagtcgtgtctgactctgtgcggccctatggactgcagcctgccagacttctctgtcaataggattatccaggcaagggtactaagaacgggttgccatggcctcctccaggggggcttcctgacccagggatcgaacccaggtctcctccattgcaggcagattctttactgctgagccaccagggaagccccaaagtaggttattatccccactttattaatgaaatgggttatatgcccatttttcagacctgagaagctgagatcaagaatgtgaccagagtcacacagtggcaggggcaacatgccagcagggtctttccactcccagctcatgttttgaaaagcattgttcctgaaagaggaagaaagcaatggggagaggtggggtgagtcctataaaatgtgacacccaccattcatccagggctggggctgccctgaccatggacttgactattctgtggtgtatgtgggccctcatgccatgaaacagtagtcattcactggtcacctgattctggtgaccccaagttcccccagccagctgctgagtcagcttggccttctccagcaatttccctctggggagagaaaggcttgttctcctgcaccagaccacccaggaagtctgcccctgaagtccaggaagtgtgaccagacataccagtcacccccagaatgggtagcttctggagctcaaaggaccaggcctgagagcctctggaccataaggtgctgccacctggcaaagcttttctccatcatcatgacctccagccatgctccagctgagcaaaggacaaggagctggcctctgcaatgtgcatgattcactgcacttaccttttcatcagagccatttttccaatattgcacatggtaagtccatgagttataaatgttcctcatggtccacggttcaggttcattctcaattcttggggcaaagaaacgcacatgtaaagaattagcaagtgcttctacttgcattctgggaggtccgatagtggctgaggacgagaacaaagcaaaatgacaatcaaaattcccatgttaaaaacatcaacattgacttttcgtaactgggcagcccaactgggctactgaaatactctgtccttgatacaccactgtggtgatgttgaccgatgtggctaagaacagttagattttgtttcttaaaacaacaaaaaaaacctttttacctttgcctttattaatcaggtttggtcctttcatatttattgtgatttctgatatatttgcaattactccaactacattactttgtgttttctgtaaagactgctttttttgtttttaatggctcattcctcttcccacctcccttttatttttattttttttgattgggttgagttttctttatttccattgctgggttggaagcaagagatggtatttctatttttagtgtttaacctatataattaaaccactttccaacaaatacattttccaacaaagtctgaaactactcccctctcccaaaagctcttttacaagacattcacatgatgcgttccttcaactcatttgggtctctggccaattgctgccacctcagagagaactgtctcaccatgctatgtaaaaagcactcccaccactccctgtcctggcatcttactttattttctttagagccacggtcagtatctgtcataaaatacgtacctgtctatttatcgtctgtcttcccgattggaatgtacatttcacgaggcaggggttttagtcttgttcaccgcggtagcttcagcacacagtaggtgctggcacacagaaggtgctcaataagaactgtggaatgaatcatgaatggcccctggcaatcatgctgtttgagttataccttgtattcttgtgtggcgactgttacatttggggggctgcgaataggcctgggttagcatgctaccctatttctactctgctagaagttgaagaccagataagaacattcatcatgtgttttaccgaagcaagtataaataggttcacgtgacattttgaagcactctcccatcatataaacttcaagaggcaaatatcggatgcggggttgtcattgctgaaagccctgccacagaggaagcctgggtgtgaattcctgtgctgcttgctcatcacccctgtggccttggggcaaaccgcatatctactgatatttggcatcagttgctaaagagaacttccataaatggccctaagataggatctggaaccagtcaggaacctgtaagtctgctcactgcagaagcagaaacctgtactgtgttttctgccttatgctgatcctggcctgtctctcccacaaactcccttaaggtcacagccttctttgttacaacccctttgctcctcatccaaggccatccacttggtgggcactcaaagaatttctgcccatgggccaaccaagggggaaataatcaaggcagggtgatgacattacaatgagatgaaaactaaggcggcttactgtcatccacaggacagaaggtgatgtttatccactctgaactctcatcagcaaattcagccctgactctcaaggtgtggtcaccatacttggaaagacttgagaaatcgcattccgtcaacaaaatactcgtgcatgtatcttggaatttcctgtaactacaaaatcagagaaaaaaaaaaaaaatcatgagaattctatttgggaaattaaaacagaagaagtcttgttcaggcttcagaagcaggaaagcaggcccttgaccttgcttctgacttgcttggacactgcctggattccatgcctgcccataagcacagctagtcaggcagcattttagatacgaaagggactggaccttggaattcttgagcttctggtgaaagtcactcacttgtgtccgactctgcaaccccacggactatacagtccatgttattctccaggccagaatactggagtgggtagccgttcctttctccaggggatcttcccaacccagggattgaacccaggtctcccacatggcaggcggattcttcaccagctgagccaccagggagctcctggaggtctggccaaccactcctggtggctgggagtctcagtttcagtctctctgaggttgtcattgtatatgcgcattttctaaactgtgctccgtgggaccttaatgatccttgacgtatcattaagacatttcaaaaataatccatcccatggtcaaacaatctggggcaaaaacaaggtgaaacatgaatagatgtctcttctcaacagaacttctcagagcacgtgtctttccaaaaaggggttgctgctgctgctgctgctaagtcgcttcagtcgtgtctgactctgtgcgacctcatagacggcagcccaccaggctctccgtccctgggattctccaggcaagaacactggagtgggttgccatttccttctccaatgcatgaaagtgaaaagtgaaagtgaagtcactcagtcgtgtctgacccttagtgacaccatggattgcagcctaccaggctcctctgtccatgggattttccaggcaagagtactggaatgggttgccattgctttctccaaaaaggggttgagtattcaacatatttgactaagaaagcttccctttttgattatgtatctctgaaagttgtggggcatagtttgtgaaatgttgatatacacacattagccaaaataggtatatcacaacgatttcaaataatgccctatatgtgactatggctcaattatgctggaaaaattataagaagaactcactggtctcagatctccaggccaacacccagagggagggtggcagaaacatggtgtggaaggaaagggatgtaacttaacctcataatagcctcaggaactataatcagtgccacctgatgtaaggaaatccaggatcttgtcttgcaaaaagtaagaattttgtctgattggcaccctcctgccttggtgccaaaaacaatctagctgctctcagaggtgacaacgaaggtgataaaaatagtaacaaccaacatttgtcagcatgcaggtgtccagcagtgtgctacttcaacagtactacctcactgaattttcacaggcgggcagaaatgacatcacccttattctacagacaaggaacagggtggaaagtctagaaactcgctcatggaactcaggtctgcttgacttcagagcgccacctgcacactccaccccactctcaggaggcagagataattgggcttactgtctgcttgtttcactaaataggccataaacactttctcaatcaatcaactttttatggctgcttaacatcccatcattgggaaaatccaggggtcattccttgaaggggcttttcccacatgtagccatttcttccatacatttaaactaaagcatcaattgagcagaacacagagtctttcaggttattctgcagtgacttccctttcattaggtcatttttaaatagtatctacacatacctttctttccattaactagttaatgtgatctgttccctgtatttacacctagttgttttagatgtttccatattaaaaccaccagtacattctctgaagccccacccttggccacccctatgcaatgcacacagacaatgagaatttgtgctgtgtgaccactcaggctgaattctaatcaaatgttttctagagccatagaagggtaaacacatttttcagggtcaaatttcttccacacccagcgtatgttttgttttccccagcagaggcccggctcggtctacacatctatgctcaggagactggaatccaggtttcactcttagttatttgcagctctcatctaaaagacaaacatctaaaaccaaacccttctactccaatggcaaagaaacaaagaacagaacaataagaaatacactatagggagagagagagacagagaggaaagctaattttccacaacgaaacccccagagctatcaagacagagtggagaaaacacagagatgaaattaaccaatcaaggctagaaaatacacagcatgggaaaaaaattaagtctccggctgacccatcttaagtcctcggggagactgacaaaactggaatatggactgagatgccaggacagcaccactggcgaaactgccaaatcttgatgctgctgctgcagtaatgtaaaaggttatccttgctcttatgaaacacacaatgacatatcaaggggcagaaggcattatgtaggacagaggcactatcagttcagttcagttcagttcagtcgctcagtcgtgtccgactctttgcgaccccatgaatcacagcacgccaggcctccctgtccatcaccaactcccggagttcactcagattcatgtccatcgagtcggtgatgccatccagccatctcatcctctgccgtccccttctcctcctgcccccaacccctcccagcatcagtcttttccaatgagtcaactcttcgcatgaggtggccaaagtcctggagtttcagctttagcatcattccttccaaagaaatcccagggctgatctccttcagaatggactggttggatctccttgcagtccaagggactctcaagagtcttctccaacaccacagttcaaaagcatcaattctttggcgctcagctttcttcacagtccaactctcacttccatacatgaccactggaaagaccatagccttgactagacggacctttgttggcaaagtaatgtctctgctagagacactatggcagaccttaaaaactggtgaatgtggatataggctatttggaagttttctgcattatacttgatattttgaaatgttttattacttgggaattattttgaactaaaaagttaaaaaaaaaagtgtaaacaaaggtgatcttatttatatttctccttcttctttgactcagcaagctctggatatggtggtaaaacgaggagtgtaggatcaaagcatctgagacttgcatctctcccggctcacggagggtgtctgcaccccctcccagctcactgagggcgtgtatctgcctttatctgtttctgagccacacaggaagcaggtgtgcggctcactgccctttggcctcctgttgctgttttgcacccgtcacaaagatgcgtcacctgcagcccagcctgtgacatatggtggcaggcccggcacagggagaaactgacagggagggcaggtcctgggagctcggaacatcactgaggtcacactcaccctttcttcttaagcctctgctgtcttcagaggagacagctttcaacagccagcagctctcttacaattcagtttcgggacaccacctcagagtagctgagcacccactatgcaaatgatctgtacctcccagcactgaggtatgcagtttataacctaggcgggtgagtggtaagctagcaaggggcttcctgcctgctttgcatacctcggttttcttggatagctcccacttacaaactgttggctttaagcaatattactctgggcctccctggtggctcagacggtaaagaatctggctgcaatgtaggcaacttgggttcgatccctgggtcggcaagatccactggagaagagaatggttattcactccagtattcttgcctggagaattccatggacagaggagcctgggggctacagtccatggagtggcacagagttgtccacaactaagcaactaacactctcattttcagcaatattactctaataactggaagatggtctcatcattggcatttttctcttaaaaaacatcaacagtgataagcctgataagttcacattgcagcaagctgccttggtggctgatgacacccacgatctataggctaaaatgtctgtcacaccatgaaccatcacaagaaacaggagaaaggattttactgtctgttttcagggaacagagctttcacaagaattctgggacagaatgaaaaaggccaggggaaatgctctccctgggctgttatggtcacttgggtgacagcagtcaggctctctccttggtccagcccagtgaccagccctgccaaggccaccatcctttggtgccctcctgccaagagcggcccagacttgcctttggtactgagctgtgaacgtcagattccccttgggaaaagcaggtgactcccatcgtagaatattcttgaaattaactgaattcattctgacattttcaggaggtggaaccattcctaatgctgtaaacataaagggaaaaaagttggcaactctctttctcaaaatagttgcccaagaaaataaccatgtccaatactcaggtcatgtactctggctcaaagtcttcacatgggcttgtgggagagggagacacgctttagcagtgctgaggagtctgagatggtatttgaagagaagaaattgctaaggggaggacagcaatagagacgtggggatggatgaggtgacctggaatttgggtggtggcagaaaggtgtgagggctttccaagtggctcagtggtaaggaatctacctgccaatgtaggaaacgtgggtttgatccctgggtcaagaagatcccctggagaaagaaatggcaatccactccagtattctcgcctgggaaatcccatggacagaaggagcctggtgggctaccgtccatggggtcaccaaagagtaggacatgactgagtgactaaaacaacaacagaaaggtgttagggggtagattttaaatctatttccagatgtataaactttagacttcctgatacattcggtgtgaagaagtagatgttaatagccactccttgcttaagcaccttatgctctgactggggctgggggtggaaatcaaacaccaccaaatattcactgagaggactgttgctgaagttgaagctccaatactttggccgcctgatgcaaggaactgactcatcggaaaagaccctgatgctgggaaagattgaagacaggagaaggggacgacagaggatgagatggttggatggcatcaccaactcaatggacataagtttgagcaaactccaggagacagcaaaggaaaggaaagagaagcctggtgtgctgcagtccatggggttgcaaagagtcagacacaactgaacaaaaacaacaattttaggatttgcattaggtttgagatactgaaggatacataagtaggaatgtcagagacagctggatgaataagcctggggcacagagggtagatttgagctagagatagaaatagttgttaaactttttaacagaaaatgccaaacatacacagaagtacagagaagagtataataactgccaccggaccatcacccaactagcaccaacagatagaaatttgaaagtcacgagcccatgttgttgttgttcagtcactaagctgtgtctgactcttctgcaaccccatggactgtagcccaccaggctccttctaaccatgggatttcccaggcaagattactggagtgggttgccatttactactccaggggatcttccctaaccagggatcaaacctacacctcctgcattggcaagataaattctttatcaccaagccaccagggaagtccagtgttagtgttagtcccgccacagtgttaagactccttggcaccccatggactgcagctggccaggctcctttgtccaaggaattctccaggtaagaatactggagtgggttgcaatttcattctccaggggatcttcccctcccagggatggaacctggatctcctgcattgcaggcagattctttaccatctgagccaccagggaagcccagagttggtatttaatgccaaagttctgctggtagcccctagagaggtagtagtgtaggagaacgagagaagagaactgggtatgaacttggctgatagaggtggagaatcccagggagaaacagcctgatataggtgggagggaaaccggagaatgagagatccatcagaaaggaaggaaggatccatagtgttatttgaacctgggcaggcagtttggcggactatcctgtagcccaagtggtaaagaatctgcctgcgatgcaggagaccagggttcaatccctgggtcgggaagatcccctggaggagggaatggcaacccactccggtattcttgcctggagaattccatgaaccgctagagaagcctggcgggccccagtttatggggtcgcaaagagtcggacacgactgagtgactaacacacacacagtttggagcaggacaggaaaggtttcactggatttagaactcagaagccctagagctgtaggagttgaggggcagaattcagactttggagtgctgggcctaacagcccgcccaggaacttaaactttgagcgcgcctctgggggtgtgctcgggggagggcgggggggttgtctttgggggtcaacgctgcccggcgtcgtagccacgcctcccgcttcccgcgctcacttcctccagtcgggacgcagcgccacaggcgagacggggtcccagcgcgggcagccccgggggtcgagccgacgccccggaggctacccagcgtcccctccccgcagacccctcacctgacatcaggaggcagccgcccagccagctcaggaggctgcgcgccatagtcgcgccgggacccaggagggcgctcaagcgggggagccccgcggacagccgccaggcaccggggcacaccccccgaccccttacgccggggtcgcacgtacgcgcgccagcctgccaactccgaggctgcttccgggaaccgggggaggggcggggcgatagaggccccgccctgcagggcccgcccccgtctgggccccgcctctcgctccctgctccaggggccgctgtcagccgcttgactgtggcagaaaaggaggtgaaaggggacttttcccctgcgggtgagtggaaaacaccgttagtaaaacagggtgcgaaactgtacatgcagtgtccccgattacattaaacgcatgctttgaaaggagccctcaagttaaatgaatacactccatatagtaaagaatgtgcctgcaacgcaggagacccgggtttgcttcctgggtcagaaagatccccttggagaaaggcatggccatccacccactccagtattcttgccttgagaattccgtggacagaggagcctggggggctgcagtccgtagggtctcaaaagagtcggatacgactgatagactaacacagagccaacccagagttggtatctgggtggtgggattaagggtggtgatgtttttttttttttttcttcttctgtttttcctgctttgtactttattcaaagaagatgaggaatgatcttcaatatttgggaatacagaggtctatcagaaaatacagcaattcattttgagctaattctaattcatcctctgtctctctttttttaaaatatatttttccctcccttcttgctgttatattagtttttgtccaggtaaatgctaactcatatagtgttcagttcagttcagttcagtcgctcaatcgtgtctgactctttgtgaccccatgagccgcagtacaccaggcctccctgtccatcaccaactcctggagtccacccaaacccatgtccatcgagtcgatgatgccatccaaccatctcatcctctgtcatccccttctcctcctgccttcaatctttcccagcatcagggtctttcccaacgactcaggtttttcttaacactgtaccgtattccccaaattttctccagtgaacggttgcagtctctatgatcgcctctcccccgcaaataaactgattttaaagcattccattagcaaatctagcttgagaggatcttctttactttaactcccctctcccctcagggataagcggcaacagagaaccaagtcattaacgtgaccagaatcatttctctcacaagactgctgacaaaggcttaatttcctccttttcaatgcgttagtagcagtgatgaggttggaaaacccagagcagggtaagtactaggtgatgcaagacactggctgacttctgtcgctagaacattccacaggaacaggagctcagggaggcagaaggtccctttggctcccagaggccacgaagtagagggagttttgtgtaacccagagatgccagcagaactacacatctgctgcatatatctcctgtctaataagaaacaaatgtggaaacatttccaagtttatattaaaaagtatgttttattttttaccaaccactgtacaaaattatatcttaaaatatgacacagaccctgtccctctcccttatgcaaatgtttctctattagtcacctgtctggcaccagagttattatgtgtgtgtgtgtctgtcttcctcactcagattgaggagggctgagagttgaattctcaagagtgtaggcgacacaatattatctaggggtgccccagacttggttggggcttccttttttccaatcccaacccagagcatgtgcttctgtttcctcgtgcgtgtccttgctttctaactgcccaccctcccttctctttttctgtggcttttctggtctttcctcaagcctgtgggggaaaaaaaaaaaaaccactgctgactgctcctgctatgaactctgctgaatgtcttccttttctctccctactccacactgacccgatttaataatttcccagaaatcttacagggccctggaacattgcctgaaaaccacagggaactttgttctttactctgggaaacatgatgcagaatcattagacatccatgacaggaaagggaacaggcagggcattttccccatcaaggcaaattgccttgaacaggtaaacagtgcactgaataatagcagaatgctctgtttcccacctcccctccccccagagtgagcatttgcatagatgatgtcaccagtgtcctactcctccccagggagaacactcggaggccccaaaggagcaagtgcaggtgctgggggtggggggtgatgtccagaggcagcgtgtgtccaagttaattaaatttttttagattcacttgtcttactatatacccatcccccatgtcaacatctgactcggaagtgtcacttttatcagaaggagcatcttggggcctcgggcactccgtagaggggttggtgaagggcagctgtgtcccttcttcactggccaccaaaacgcttgattctgtctcgttgaggtcctccagctcgactgtctcttctggacaagatggggacattagagtgacttctgagtccttgtcatcctcaagggctctcacacacacagagttcaaattcacgttgaagacgattctgccctcagacccctccgtggagtcactgtcctcctcggaagtggggtcctgccacagagtccctctcgtctggtagcccccacttgtgccttccgactgccaggggccgggccctggtgccatgggggtctcggcgtcccccttgggctcaggcagatacggctcctcagcactgggctcactgcagtcctccaagctgcagtcctccaagctgggtgaagtggtggaagttggacacagcttgcccgttagtccatgcttggtgtaaccacctgaaattaagtggggagctgcctcattttcgatgtcattttcatcgtcataattataattccacactttcttcttcctgttgacgtgaatgacttccacggtagccactttttccaacgggggcagctcggcaaacacccagactgacagtttataaaaattctttaaagaaaaacaaaaaaagagagagagaatgatcagtcctgagtgtttgttctctatctttttgacatcttaaaacttaatggagttaactaactgcacagagatgggaaaggtggccatgaagatgatgacagcaactacaacaatagcggacagttacacagggtttactgtttgcggagtactgcttttagtaaactacacgttataattcatttcatcctcacgacttctctataaagtaggcttactagtcttgctccactttacaatgcagagaggttaagaaacttgcccaagttgcaaggaacactcagtggtggaggctgggtttcaaactaggaggctgcctgcagtagagactggcccactccttcccactgctgtccccttgctgcttcttgcttgttaggggaatctatccgtcagtagttttgatagatggatagatttcaactggatagatttcacctccggattgctgacattcttatgggtgtcaggaaactgtgagtaaggagagattctagggagctgatcccactggggtcagaggtccctggactggaggaccttagagatgcaggtgacccctaaagggtcagagttgagaaggaacagagagactggaggttgctctaacccagcaccttcaagatacaacaggtgaggtgggctaaggagactggctacaatgaggtcatggtgaggagggtggtcgcgagattccctttgcaaaccgtgaatcatcatcagcatccttctcctttccattgtcttggtcaagctgcccaatgtgacaagcctacttttccctgactctattcagatacagccttaggatgaattgttctattgggttgtttcgtaatttttcttatttatttataggggctgtttgtataaccttgggcttcccacgtggccctagtagtaaagaacctgcctgccagtgccagagacagaagagatgtggattcgatccctgggttgggaagatcccctggagtaggaaatggtaacctgctccagtattcttgccaggaaaattccatggacagaggagcctgacaggctatagtccatggggccacaaagcgttgaacacgactgagtgagcacttatagaacctagatgttaattatttgttgattgtttatgctgcatggattttctcctagtctgtggtttaacgttttactcttgttatgatgacatttaatggaaagaaaatttccatcttaatttaagaaggtatatcaattttctttctccatggtttctgctgaatcttccttatctttaagtatgactcctatatgcccttctaaaacttttaatagttttgctgttcatattacagtctttaatatgcctgaaactgatgtttgtgtatagtgtgaggtaggaatctgatttcatttttccccacatgggtagcatttactgacctcaatcctttccccacagcaattcctacaaaaccctaagcctaaccttgtttccacatatgtgagtctgtctctgagctccccatttgactagatctttgttaatgcctttcaacagggtttgataattttctccacaatgggcttgtgacatcttctgttagatttcttccttaaatactttaacaaatatttttattactattgtaatgacgttttaaaaactgtatgatttcacttaaattgcatgattccattgaactgtatgattctaaggtcaaaaccaggtaagactaatctatgctgttagagtgtagagagtggttatcctgggtgtgggcagtgactgagaggtggaagagagacttctggaaggggttggtcatgttttctttcttgatctggatgtgacttatgtgggtttgttgagttcgtgaaaattcagttttttgctatgacttgtgcactcaatttcttggatgttgaaaagcaacttaatagaaaaacatatttatttttaagtgactgttgctagggtataaaaagcagcggttttatgttgattactttgtgtgtaacaaacttattagtctaaataagtggctaatgtggctcaacttattagtcctaatacctcatccctagattctgaatttcttacttagccagtcatatcatctaataatgatcattgtctctgcccccatttttcagactttaacctccataagggcatcttttctgttttttttattcacctctagatccccagcacccagcacatgtggatatacagtaaatacacaacacatatttgttaaatgcaaaagaggaggtgtaggaggaggaaaagaagagaagggggaaggcggtggggggagaggaggaggaaagaaaagacagtttaaaatttttaacttctgttcttgtttagacatacatacacaaacatactagacctagggtgttctgttttactgttcctagagtttgtacttaaacacagagcaacactttttactggagaaatagcagacagacacaagataactatacttgctttcattacttggagataacataataactggtataaatataattggcatataatttgggttcattttaaggacaggaaaaacccagggagacctgggagaagggttagtaatgagtttaggtaattcaggcagaaaattatccaggacatgatgggtgtagtgctaggggtttttatatctcaaggctgcatgagaaacatcagttggagtgggatttatctaagagctcaaagccacagctatacatggccaacagaagagttggagtggaggctgagagtaagcctgcaactgaacagtaacataaaaaactcaaaaagatatactgttaaagctacaaaagattaagttatactgatagattaaaaaaaaaaaaaaaaaaaaaaagccacgacagggatcacagtatggataaaatccaacacagagccatttacttctcgtaagccacagccaaatgccacctaggttcaaatactaattataatgaaaaactccacaagcacccctcctcccaaacagtccatcccccaactcaacctaaacaaacaagaacaagaaaaagaagagaatagcagtcataacaaagagtgaaataatgccagttgcaaagacttggatggacctagagactatcatattaagtggagaaagacatattaagtcagagagaaagacagatatcatacgctatcacttatttgtggagtcggaaaaaaaaatgatacaaatgaacttagagaatcctgatgggctacagtccgtggggtcacaaagagtcagacatgactgagcgactcacactttcactttactttttcattactgtataaaagtaggtaaacaataaggacttattgtatagcacagggagctatattcaatatcttgtaataagctataatggaaaagaatctgaaaaagaaattatatatattctttttcaaattcttatatatatatatattattaaactgaatcagtttctgaatgcttgaacacagcattgcaaataaactatacttcaattaaaaacatttaaagaaacaaaagaataaaaaaaaaggactatacttttaccacctgtagagagagatttatttgtggctatttaaaaaatagaaggtgaatgagttcaaacatagaatatcttctaatgtagaaggaactatctgaatatcttctaatgcagaaggaaagtgacaggacagggaaaatgaaaaatgatgggcaaagtggttgaatcaaaacatgtgaggaggtgttagaaatatgtaagatcagtacctagacttggttgagtgccaaagattctgagcgggaagaatatgcctcatgaaacacagagaaaacacaagaccaagtggctggttccacttacgaaggacacacataagagacccctgggggaccgttatactatgataaatgagtacaagtagaaaaaaaagattaatcaatgtaggcaaagctttggagaaagctgtacaccacgatgttgacactagcattataaatcggttctttatattttcatataagatatattcactctgtgtatatattccacataagtaatccaaactaaaatgacaacctgtattaaaatgttcattgtgttactcctaatggccgaagaaatgaaaggaaaagaaataatgaaaaggaaatcaatccaaatgcccgacagctgagaaatgattaaggaaaaaggagacattaataacaatggaacactgtgacgatggaaaatcatatgtggacaaagtatgaaaagaaagcagaaaatgcaatatataggtttataggaatggtaaagaacccagagtgatacaacaccttgatgttttgagaaaatagggtttcttctatgaagatatttaagtatataataaaaattcttaagtcaaaatgaaaaataaaggtagaaatgaaaaaaaaatacataccaaaactttggggaaatcatttcttaagcatatatagccaatccgtttcagtatcattacagtgcttatgaagacagcagttattaaaaacagagtaattattcctcctattgtagcagattctgatgactctgttgatgaaaaattaaatggctttatttaaaagtaaatccactgaacactcacagttgggaacaaatgtatattaatctggtggtggaagggtttattatgggggcaaaagttggaaaatctactgtttaatatcaaagaatggaaagtaatccaagtatacatttttaaaaaatgttaaaattcagtttctaaaagtaaaatttcttccagttgataattattctttatgactgcattgtccaataatgtggtggtttagccacatgtgaccatttaaatataaattatccaaaaaaaaaaaaaaaaaaaacgaaaaaacaaaaaactgtttctgagtcatactagccaggtctccagagggagttgaaaaagggagtttgtctgaagatgacaatcgggtcacttggaagctggactctggccatgccagaacccagaactggggtgtggtagatcttgttttgtccagttatgagttctcctttagcttcttgtcaaaataacttttcgaaaatttcaattttctgaatgtaaacagctttttcctgtaagtccaactaggctgagaagaaatcagtacttatagaattaaggctgtctttaatatccagaaaatcttttattaatattaatcctataaccacagcctcaagcaaaacaatacaggagaaaaacaactaaagatggctcatatctttctaatgtcttttaaaaggttaaagaatggacagaaagaaactcggtgaagatctgagcccttagacggcagaagactcatgaacccctttcattcccatcaagaatgaatgggccatcatcaagaaaatttacaaataataaatgctgcagagggtgtggagagaagggaaccatcctacactgcaggtgagaatgcagactggtacaaacttaaggagaacagtatggaggttccttacaaaactaaaaatagagctactatatgatccaacagtcccactcctgggcatgtacacagagatatatgcaccagtgttcacttcagcactatttacaatcaccaggacatggtgcaacctaaatgtccatccaccgaggaatggataaagaagactgtggtacatatatacaatggaatattaccaagccataaaaaaggatgaaataatgtcatttgtagcaacacagatggatctagagattgtcatactgagtgaagtaagtcatatagaaaaagacaaatatatgatatcgcttatatgtggaatctaaaaaaatagtgcaaataaaacttattcacagaacagaatagattcacagatgtaaaaaacaaacttatggttaccaagggggaagtgggagagggataaactgggatcgacatatacacattactatatataacgtagctaactaataaagacctactataacgcacagggaactcttctcaatactctgtagtgacctatacggggaacgaatctgaaaaagagtgtatatatacatatgtataatcaattcactttgctgtatacttgaaactagagtaatattacaaatcaactatattccaataaaaattaaaaaaaaagaatgaagatgtgtcatatcaatggcagctatagaatcagatctagtcataaaggcacacctttataatacaaaatccttacatgtatagagcttacattcctgaagaggattctgtgaacctacgcggtttctttggaggagcaatatgatgtcatgggatcttgacccgtgggtcccacccctctgagtcccttgaactagaatttctattttggctctgcttccagggaatgtaaacatgacaccaccctatttaaaagagacctggggcttccctggtggtccagtggtaaagaatctgccttgccatgcaggggatgtagactcagtccctggtctgggaagattctacatgccatggggcaaccatgcactgcaactaagactcaatgcagtcaaattttatatacatatattcaagttaaagagacctaccagatgttcaagctggttttagaaaaggcagaggaaccagagatcaaattgccaacatctgacggatcatcaaaaaagcaagagagttccagaaaaacatctatttctgctttattgactatgccaaagcctttgactgtgtgggtcacaataaactgtggaaaattatgaaagagatgggaataccagaccacctgatctacctcttgagaaatctgtatgcaggtcaagaagcagcagttagaactggacatgggctaatctaactggttagaaccagttaggactggttccaaataggaaaagaagtatgtcaaggctgtatattgtcaccctgcttatttaacttaataaggctatggtttttccagtggtcatgtatggatgtgagagttgggctgtgaagaaagctgagtgccgaagaattgatgcttttgaactgtggtgttggagaagactcttgagagtcccttggactgcaaggagatccaaccagtccatcctaaaggagatcagtcctgggtgttcattggaaggactgatgctaaagctgaaactccagtactctggctacctgatgcgaagagttgactcattggaaaagaccctgatgctgggagggattgggggcaggaggagaaggggacgacatcaccgactcgatggacataggtttgggtgaactccgggagttggtgatggacagggaggcctggtgtgctgcgattcatggggttgcaaagagtcggacacgactgagtgactgaactgactgactgaactgaccatcctttaccagacattacccctcccctgccctttctgcttaatttttctccagagtattatagtattatacttaaccatcccttaacacaatacatattttatttttttgaatcttgttcttttgtctcccaatgtaaactctataaactaaggaatttttatctgttttattcactgctgtatccccagtatctagaagagtatctggcccatagtgggccccaataaacatttgtcaaatggatgaggacacctttccctggggaacttactgaaaaaaagtcagctgattagtttaagatttgacaagagggaggcatttctccatttctctggaataaatccccgtttatcaatactgctttaagatatcagtgttttaccactgatatcccagtaacttaactctggttctagctcaccctttaagaatcccccaccatccaaacctacctggtccctgggtttagctggttgagggtggctcacatggccagtttacacagtgagaggggtcacatgatctgaacctacttggttcctgaagtttcagacaagaattgtggcatgaaatatttggatagcgaggcatacctgtaccttaactgtctcatgtaatgataaaagaacagacgctgaagtatacaaagtgatgtgttcctaccacggaagcatgaagcgatgggccagcatgttgccatatgaccattcttagcaggtgaaacagggaagagtcaggggagacactgagtcaccacagagcaaggacatcaccttccagtgcctttggtcaggcagtggcaccccactccagtcctcttgcctggaaaatcccatggatggaggagcctggtaggctgcagtccatggggtcgctaagagtcaggcacgactgagcgacttcactttcatttttcacattcatgccttggagaaggaaatggcaacccactccagtgttcttgcctggagaatcccagggatggcagagcctggtgggctgccgtctatggggtcatacagggtcagacacgactgaagcgacttagcagcagcagcaggagcaggttcacctaagggcagactgagtttcagccaaccacggtccgtcatgtcctatttctaatctgagtttttattgctgtgacactctgatttataataagaagtacatatttggtctttgtcctcaagtctgaaacccttagaaattcctaaaaagagcaaagaaagtgaaaggagctttttttgttattcagaacaagcccctctgaacttcacttggtttatgtgaaacccaaaatgaatgaacataatttgtgtcctaacaccaattctcaacatcaactaggtgtccagagattcgactcgtttctgatagtaccaggagttagtgcagaacccacagggctatctatgggctttgatgatttgctagaatggctcacagaactcatgaaaacagtttactccctagattcctggtatattataaaagattataactcaggaacaggcagaaggaagagatacacagggccaggtatgcgggatggagcttggacttctgtgccgtctctgggcacgccatcctcccagcatctcagtatgttcaccaacttgggagttctccaaaccccatcatttatggtttttaagaaggactcgttatatagacatgaccaattaaattcttggccactggtggtcacttcaacctctagcccttctctcctccccagaagtcaaggggtggggctgatagttccaaccctctacatcacagggttggttgccaggggaactttccaaatgtcaacggatatgaacatctactgctcattattttctcaggaagcctattgttttgccctgtgtatctcttccttctgcctgttcctgagttataatcttttataatataccaggaattggtgttaggacgcaaattatgttcattcattttgggtttacgtttttataagagccataggcatgaagagactatatgcagttttaggtttgttcagttgctaagtcatgtccaactctttgcgacctcatgaactatggcacgccagacttccctgtccttcactcactgtctcccagagtctgctcaaactcatgtccaatagttggatgccatccaaccatctcatcctctattgtccccttctctttccctcaatctttcccagcatcaaggtcttttccaatgagttggctcttcaaatcaggtggccaaaggataggagcttccgtttcagcaccagtccttccaatgaatattcagggttgatttcctttaggattgactggtttgacccccttgctgtccaagggactctcaagagtcttctccagcaccataatttgaaagcatcaattcttcagcattcagtcttcttagtggtccaactgtcatatccgtacatgactactggagaaaccacagctttgactatacagacctctgtcagctgctaggttggtcatagcttttctttcaaggagcaagcatcttttaatttcatggctgcagtcaccatccacagtgattttggagcccaagaaagtaaagtctgtcactgtttccactgtttccccacctatttaccataaagtgatgggactggatgccacgatcttagtttttttaatgttgagttaaatatgggcaaagttttacccatatgtaacggacattacatttaagttaaagctgtgaaatagtttttcctttaaaattgatctgtgtatcatttgattctgagtaacactggtgaatcaactcacactgcctggagttatagcaaacaccaggcaacttgacatgtcagctgctcattagtggagctcacttcatccgcaaagaagccatcacacttacagtcactcccttctaaatctcatcttattttgactctggtaaatcagagcactaaagaaactctcactgggattgggaaattcagaaaggcttctttgggggagattttcatagattttcactctgggcaaaacaattggcttcctgagaaaataatgagcagtggatgttcctaaggctgactgtccttcctgcaaattcctccattcgaaggaaggttcggggaggaggttgtatgctgttttgacgcgttggccacagaagggctttcagccttcatccgtgaccagctcatccacactggcaagttccattttcatccatgagttacagccaaccttctggagagccaggccatgtctgtggacctcactgcgactgtcgtcctaccctttggcacctctgcaggcagttgcttcaggaaccaagcctcctccaacacttgacttgaataacggccaaaccaaggccacacagaactgaacccgatcctgccccagaaataaatcatttccactttagcctcctgaagtggaagttacctgactgtccccatgggatggcaacataaaagcagctctaccacatggtagagtctgaccaacagaagacatctctgtgatgtgccttgtcggatgaaatatcattagtgctttgcgattttcagattaagcaaaccatgaattttcaaaaactgtcatacctgattctcgtctgggtcgaaagagggtacattttaagggagatctgtttatttttcttggatctttaggctcaaaataaacggatatacagtagtttgtgtttggaattaacttgtcgatgacataattgaaatttttggtgatgtttccagttatttggggttgatgctgtaaaaatgtgcaaaagagaaaaaaacatcagtaagacattaagtgagaatttcgtttagaggcaagccctaagagagtctttgagaattggtcttcaaatcttaaaaacacagatagaaatatcataggcttggcaagaaaaagttatttataagttactcaggcaaatgatttattcaaaattacatgcacatgtataaacacacacatctttaaccatgaaatctagtctagcaacttcctttgacaaatgaggagaaaaagacccaatgaggaataaaggtctccaggatgtcatttttgtaaggtgatgttactcaagatcaccttgcaaaaatcagaaaataagattatcctacttcattaatgatatgaatctacacttcagaaactgctttcatatatattaattcatctgatgatcaaaagagtctgaaaagtaggcattattcccgttctccagatgaggaaactgtagctcagagtggtttagtaacctcctcaaggccacacagttctgtggcagaactgaagctgaggtctaatttccctgtcctttccctaaaaacaccttgcctcttcttccctggctacttctgttccattttggaattaaacagatgatctgaagaggttctttcatgaaaaataacttttgtagaatggtttatagtctttaaagtacattcttaccaaaggtttaataaatgaagctttccaccagctcaaatacagcattctataatatttttctgcaagtttctatttggaaggaagaggaatttttttttctcaccccaccccgcaataaacttaaaggtcatgcatggcgggacggagcagaagtgccctggtgggagtgctctggcctggaagggaaaccaccaaagcgtagctgggcaccagaactctgggtcccacacatgggatgatctttgtggtcatcatgtgatctgcagtctgcaacgcttgcttcctgtttcactggaagctccttcccccttggtggccgtggactctgcctcccccactatgactcagatgggtagttcctgctcagagccaaggtcaacccctgcccaaggtcatgacagtctgcccactcatctccagaacatcactcccctcccccactccccttaccacctgggacattccctccgcatagggacttgctgtcatttcttccatctaaaaagtccctccatagaccccacttccccttccagctatcatagcatctccctactcccctttatagaaaaccctggagacgtctttcctgaactcaaaagcaatgaagcccagacccttcggttttgattgtccaaatcatcacaggtgtcttttagcaatgtattcattgccaagtcagaactgttttgaccacttaccctcttaacactgttccctgcatgctcttcaataaatgctaagtaaaactgtaattcttcacttagtatcccgggactgtcgaattgaaatttcacattcacactgatgtggtttgtaaaaccaacaatctcaaactctggtgggtccaaaggctctgtttagaaaatgaaataaaccccaaggttaatcaataaatagcataaccgtaatgataaccattgtcctgatacaaccatacctctttacagctttctttttgatttcctgtggccctcgaggcatgggttatatatatgcatattttatttggtgaaaaactgagaacagtaaaagtgaagtgatttgtttactattaccacaagaaatggaggacagattttggggtgaaagtatttcacaattttcaggttgtattcgaaacataagagtgaaaaatgacttctcatctaataataatataataacaatacataaccattgcagaaatatcagaaaatacagacaggcaattgtctttgaatgcggttaatcctcttttgtgtatgcagtatgtggataaatacacgcacacatataaaactgaactagtgtacacatgtaccgaaactaaaattaaatcatactgttttacatggtgtatattttcacttatttcataaacatattaaatgcatgtttgcctatgagctggcaaactagggcctgtgggttagattttgcacagcctgaaagttgagaatggtttttatttttgaaagggttgtgaatgaattaaggctatgtgacagagaccatatatggctcaaaaagggtgaagtttttttctcagtcttcaaaagattgattcactcttttaaacagttagattggctctaatttttctgaatggaatctgcatatcagtgagtattaacagagctcagtctttgcatttggctgtaatcatttctttaggacaaattcttggaggaatttgggattagagcaagcccaggttaaggttttcaacacatactgccaaataccttcggaaagactgtgtcaagctatattctctgcatttcttctaagtctgggtatttacttactttttatatttaccatttgagtcttgaaaaaagatatctcataactgtgttaatatacattcttcaatggtctgagtagtctgagtaccatgttctataagttgggcttttctttcttttctacgaggacatgtacacaaacacgcagtcccacaattccgagaatctctaagtatccaagtttgctccatgggattcagctatcatcactttggaagcacagatgagtgtgcgtgcacacccacacagcctttaacatggctccttttgctgctgagtcactcaggcacgtctgactctttggaaccccatggactgtagcccaccaggctcctctgcccatgggattctccaggcaagaatacgggagtgggctgccatttccttccccaggggatcttcccaagccagggatcaaacccatgtctcctgcttggcaggcagatgctttaccactgagctgcctgcaaagccctctgcaagatcaggataccagagatgtgatggagtctggcagagagccactgccagctgctctggagctgttaacacaaaggccagaaggagccgcctcccacggtagggaaaggaagagtgggcacgcctactcctggcatccaggcttctctctctgggccccgtgtgcacacacacctgggtgctcacacatgccagcgctactgggatctgatctgggggaggggctgcagtattaaggaaaacacagacccccaaagttatgacagctcagacacaggcctttctgaaccccgttccacacttcctgtcaggctgtgaaacaaagcaaaaagtagcagctactgtatatcagaagtgaacacatcattctaaatcaactatactttaatgaataatagcttcaaaaaaacgtagcagctgctcctgcctgagtgacggccttatacaggcacagagagcccttattgtcaaagaacaggttatcattccacttttttggagaagaaaacggaggctcagagaagccaagtaaccactccagggtgacagagataggaggtagcagggctgggaggtgaacccagccctgcgtctaaaacacctttacagaacttcttgctttatggcaaagcaagtaacgatgtgcttagcgatgatgatgaaggtaataaacaagacaaactcactgtctggcaccaggaagaaagagcccatacaaatgaccagctttgcattctctctgaatccaaccacctgggggatgtacatgtccgtcgtgtttacccacacgtctgtgaggtcacaaaacgatcttgtgacgtttatacagtccttgacgaccttcatatcttctcgtttactttgaaaggcaaagagatggtcaaagaaagtgttagcctgtatgtgatgagggtccattaacccgaagccccgactgcatgttcctgtgtggctctgctctcaaaggtcccttgtgggttttctttcctttaattttgaaattttaaacattttattttgtatgggagcacagctgattaacaatgctgtgacagtttcaggcagacagcaaagggaagtatctccatgttgtcaccggctctcacccccttatttcaagtggaacaccttacccctctctcttgatccctctttcctgtctttatctttcttcataccacttgcccccacctggcttgttatatctttgctgactgagacctctgcctacttttggaatgtctgccccaagaaaacagggatctgggttccgagtgttacccctggcatgtggtaggtgctcagtaaatatttgctgggtgaatgaattagcaaatgttgggtgttcatggaagaggccccagatctctttaattctacaggacaatcatgactgcccctccctgagactccttctttctcagattgaggatgtcacggtctggtcctaagtcagcctatatgggacgaacacagacatctgttctcttgagcttcagaaaggcaggtggatgatacacgtgactgcctaaggcagggagaaacttacagtgttagcaggtaacaaagagaacccaatcctaaaggaaaccaacactgaatattcattgaaaggactaaggtcacctgatgcgaggagccaactcgttggaaaagaccttgatgctggcaaagattgagggagaagagggcggcagaggatgagatggttagatagcatcccggactcacaggactcgagcaaactccagaagatagtgaaggacaggaaagcctggcatgtggcaatccgtggggtggcagagtcagacatgacctagcgactgaacaccaacaactaagagacacccaccagaggtccttcagcaggtcagatagcagcagtaagagcaataagatgaacagccaactaaggacactcctaggggcaactggaccaaagtaaggcttaggagtgtgattgttggatgtgggaataagagagccgaagaggacaccatccattaggcatgactccctgcagccacccctgagcaggaggatcggcacaaggaggctgagctctgtgccgagggccacagctggttagtgaccgagccagactttggacctgggcctgtcctcgtcgggaccaggtgggtttctgatgtcccgtgtgcctccctgagtagagaggagtaaatataacctatcaatatggtcagcaggtctttggacttctgtcctcagaacgatgcagcactttcaatgcccagacttactgaactagggaagtgattgtgaataatgacgataattattttgcatctgaggctttgactgtagaaattggcattggttctctaagtacaagtgtgtcaaaaataactttggggtgttcaggcattcagtgcaattaaaaatggaggagtcttttgtcttggacttttaaagctctgaataaaacactgagactgagaggggctgagtgagggggagagagagagaaaagctctatgacaagtaaggtcacctcttccctactctccacataataggaacatgatataaattagcaagagaaaaacagaatgtcaaacctacctcatgattgtgtaccataatgtatagtgagttggtacaattgaatggttttttaattcccatgataagactgactggaaatttcggaatctcatctttaaagtgcaatgttcatctgaaagaactaaagggaacagaagttaaaaaaaaaaaaaaaaaaaaagattgaaatctggaacccagtgttgttatcttggccatggttcaaactgtcccttgggatctgaactcccacatttctagcagagaagcccctccaagagggctgggatcttggaaacccaaaggaaatggttttgttgaacactagaaatgagctaatacaagtaatatacaggaactcagcaccgtgtaaagagaatttggtggtagtgctttaagtggttaattcatatccgactcttgcaacccatggactgtagcccaccaggctcctctgtccatgggattctccaggcatttggagtgggttgccatttccttctccaagggatcttcccaatccagggatcgaacctggaactcttgcattgcaggcagattctttactcactgagctacaagggaaaccagaatttgggctcacccaattatcacaggctcgcagcagcaatttggatcaaaatgatctatgttatcccgggctacctcatgctctcaagtcaatcctcaacccctcctctggtcccccctacatagctcagcccatggcaagctttccttcccatgaatttcctactgtgcttgttccccatcacacaggggaggtgaagactgtgtgcccagattggatctttccaggcatttcatccccatgcctatgctggagtagatttgactcacagacccatttcacagactgtgaaattgagaagttgagttatgcaactcagctgggatatggcagtggcaaaggaaaccttacagttacatttgtcaactctgccttatatggttaaaatttaaaagagcatcttagtttcctgtggttaggacctttacctcttggttgctaagtcttcatcccccagtgctcatcacaaggctggatacatatttaacccatagcgaagttttgtgggaaggtttatatgtagacaagaaatttagtttaaaaaaacgtattttctcttatctggtaccaggtaccaggtaacaggtagaaaattgtaaattaaagagaaatgatttctggaagatttttttgtttggcacagtctcctcattcttctattagtgagaatattgagagctggatatatttttaaggggcttccctggtggctcaatgggaaagaacccacctgccaacgtaggaaaccctggttcaatccctgggtcgggaagatccctgggggagaagtggcaacccactccagtattcttgcctggagaatcccatacacagaagagtctggtgggctacagtccatggggtcacaaaagaatcgaacgactgagcgactaaacgacaaccacaagaacaattcctttaaggggtttaaaaattaactctagtgttaatttcctgtaatagttttatgagacaaatgtgaaaatcagaattggctaaattctccttctacagagaaagtatttgaggaaaaagattcaaacaaaatggcaacagatttggactcagaaatccaatttcccacattttttgacttctaaatggttgctcccccactcacacccttagacaaaattttgttaagtcaagaaaatctcttaccaggcgcaacatacgaaataccaaacacgaggctgatgtgcactggaaagaagaaaaacatgttagaaaagcaaacaatactctctccaggctcaatttatgactgtcgctctgagtctggcattcttccacacacgtgtattaatattggactaagactttcttgtgctaaagaaaaagggtcaagtaaatggttctgggcttcccaggtggtaaagaatccacctgccaatgcaagagacataggagacttaggtttgatccctgggttgggaagacctcctggagtaggaaatggcaccccactccagtattcttgcctagaaaattccatggacagaggagcctggcgggttatagtccatgggggtcacagagttggatacgactgaatgagcacacaaaatgatcttaaagagttgatggtatcagcagtgcatcttccgaggatgtttcgtcctcagtggatccaaaataagctgtttgggaactgatactagtaatgagagttggctggttggggaaccatcctgagaagcagtcatccatctggaacaattctcagaatgtgaataagcgtgttgctaattttaaaacttccgaggcgaagatatttaccaaggttggtggagggagaaaggtctcggtgaagggaagggggattctcatttgttttctgatgtcaccacgactcagaagtgggagggcagggttggcgtattttagtagctgaggccctactatgctcactgtcacatccttcccaatgcatgacatttcttgggggagaagtgtcccaaccatggataccttactggtaaactatggaacagatgacacagtgatactgaaatagaaccaaaacaaaggtaaagagaaggcacaaatgaatagggtgatggaaaaaaaatgataataaatgaaatgtggaaaccaaagttcaggggtgacattttggttttatgatgaggagggagataggagttttttgttatttagttattaagtcatgtctgactttttgtgaccccatggactgtagcctgccaggctcctctgtccatgggatcttccaggcaagaatactggaatgggttgctgtatccttctccaggggatctattccaggtggaattttttggagaggtttgagatatctgaggttattgatatttctcctggcaatcttggttccagcctgtgcttcttccagcccaacatttctcatgatgtactctgcataaaagttaaataagtagagtgacagtatacagccttgacgtattccttttcctatttggaaccagtctgtggttccatgtccagttctaactgttgcttcctgacctgcatacaggtttctcaagaggcagatcaggtggtctggtattcccatgtctttcagaattttccacagtttattgtgatccacacagtcaaaggctttggcatagtcaataaagcagaaatagatgtttatctggaaatctcttgctttttcaagatccagcggatattggcgatttgatctctggttcctctgcctttcctaaatccaggttgcacatcatggttcacatattgctgaagcctggtttggagaattttgagcattactttactagcgtgtgagatgagtgcaattgtgcagtagtttgagcattctttggcattgcctttctttgggattggaatgaaaactgaccttttccagtcctgtggccactgctgagttttccaaatttgcttgcatattgagtgcagcactttcacagcatcatctttcaggatttgaaatagctcaactggaattccatcacctccactagctttgttcgtagtgatgctttctaaggcccacttgacttcacattccaggatgtctggctctaggtaagtgatcacaccatcgtgattatctgggtcatgaagatttttttttgtacagttcttctgtgtattcttgccacctcttcttaatatcatccgcttctgttaggtccctaccaatttctgtcctttatcgagcccatctttgcatgaaatgttcccttggtatctctaattttcttaaagacatctctagtctttcccattcagcacaggctggaatcaagattgccgggagaaatatcaataacctcagatatgcagatgacaccacacttatggcagaaagtgaagaagaactaaagagcctcttggtgaaggtgaaagaggagagtgaaaaagttggcttaaagctcaacattcagaaaactaagatcatggcatctggtcccatcacttcatgggaaatagatggggaaacagtggaaacagtgtcagactttatttctgggggctccaaaatcactgcagatggtgattgcagccatgaaattaaaagatgcttgctgactccttggaaggaaagttatgaccaacctagataacatattcaaaagcagagacattactttgccaacaaaggtccgtctagtcaaggctatggtttttcctgtggtcatgtatggatgtgagagttggactgtgaagaaagctgagtgccaaagaattgatgcttttgaactatggtgttggataagactcttgagagtcccttggactgtgaggagatccaaacagtccgttctaaaggagatcagatactttggccacctcatgtgaagaatgactcatttgaaaagactctgatgctgggagggattgggggcaggagaagaagtggatgacagaggatgagatggttggatggcatcactgactcaatggacatgggtttgggtgaactctgggagttggtgatggacaaggaggcctggtgtgttgcagttcatggggtcgcaaagagtcggacatgattgatcaactgaactgactaaactgaactgaaatatattctcctgatctgttatctcattattaccctttgttgaatagaaaaacatttaattttcatagaacaccttttttggtcatgatgtgtgctttataagctttaagaaatcgttctttacacttaggatacatagatattgtcctacagtttgcccgacccggggattgaacccaggtctcctgcattggcaggtaaattcttaaccactgagctgccagggaagtcctaggggtctggcctctttccaaatataggaatggagtgataaactccaccctggattagaatgagagtattaaggggaattcctcttcaaattacaatgaagctagctcccttcattattgagcctcaagcctatgattatttagttgttttcctaaaacaccagtagaacagaaacccattgtatatcaaaccatcaacacagaattcctatctaagttccacttggctcttgacattgggcagctcatactgtgtcctcaggaccaggaaatcaactggctacttcctaacaggatccctgtagatggagctgtgagaaaaagtgacactcacccatgggatacaaattcagtggtccaatcgctgacacattctggctcaaaagcatttttgttgttttatgtgtccttcctttcctttcacatctgaaaagaaatcaatattaggtgatcagaattctgaagtacctaattaaactgcaaagacaacagacaaagacaatctgtatgcaggtcaagaagcaacagttaaaactggacatggaacaacagactggttccaaattgggaaagcagtacttcaaggctgtatattgtcaccctgcttatttaacttatatgcagagtacatcacaagaaatgctgggctggaagaagcacaagctggaatcaagattgccgggagagatatcaatatcagatatgcagatgacaccaccctcatggcagaaagcgaagaagaactaaagagcctcttggtgaaggtgaaagaggagagtgaaaaagttggcttaaaactcaacattcagaaaactaagatcatggcatctggtcccatcatttcatggcaaatagatggggaaaaaatggaatcagtgacagactttattttttgggggctccaaaatcactgcagatggtgactgcagccatgaaattaaaagatgcttgcttcttggaagaaaagctatgactaacctacacagcatattaaaaaccagaggtattactttgctgacaaaggtctgtctagtcaaagctttggttttcccattaatcgtgtatggatataagagttggaccatgaagaaagctgagcaccaaagaattgatgcttttgaactgtggtgttggagaagactgttgagagtcccttggatggcaaggagatccaactagtccatcctaaaggaaatcagtcctgaacgttcattggaaggactgatgctgaagctgaagctccaatactttggccacgcgatgggaagaacacatatgagcaactgaactgaagtgacctgggtcttacttgtggcgcgtgggatttatctcgttgcagcatacggactctttagttgtgtcccttggactcagtagttgaggtctgtgggcttcattgccctgtggcatgtgggtgggatcttagcgccctgatcagggattaaaactacatcccctgaattgcaaggtggattcttaaccactgggccaccagggaagtccccagcaggaaattcctgattccaggtttcctctctgcccttctgggagctggatcattcaccccatttacacaaggagctttatctcagcttgtgggaccaatagccatttggttccaaaaatttaaatatatgaaaaagcaaattttgaagtgtctcgctccctttggaaaactatttttattttttggttagtccttcagaatatcttcatacatgttgttgttcagtcgcctggtcatgtccaactctttgagaccctatggatggcagcacgccaggcctccctgcccctcactgtctcccggagtttgcccaagttcatgttcaccttcatgcataagcaaatacaaaaatgtattcttattctccccaaccctatttttctaaatcggagatagcaggtgacgctagtggtagagaacctgcttgccagtgtaggagacagaagagagatcttcttgacccaagggtcgaggagggcatggcaacccactccagcactcttgcctggaaatccccatggacagaggagcctggtgggctacagtccatggggtcagagtgggacacaattcaagcgacttagtacacacgtagcatatacactgcctgtctaattcctgcttttttccacttaaaaataaatttgggagctctttctgtatctgcaccaaagagaatttctttcttttttttttttttaatgtagttacatatagtctactctgtggacgtaccgtgatttatatgactagtcaccacaaagaacatttgagtgacttccaactgtttctgcaatggattctcttgaaaatgcctcattctgagcatgtcaagtctaagtgtgagaaagcttcccagaaatagtactgctaggccaaagggggttcagtcagggtcccggcaggtaagaacacattcaactctggctaagttaaggaagattttcatcaagggactatttaatacaaatgtgtgagcaggctacaggccaaccataaggatgagcatagcatctgaaagtaacagcagtgagggctgttatcatcgtgggcttgaggtacagagggaacgtcccaagcctggaattagaaaggagagagtccagcgtgaggagcacagatattcctcactgtcttccctctcctcccttggggctccccattggttgactccaatcgaagccataggacaaggcagctggtggctgtacctatacaagatgggatcccaaggcacagtaaaaggtggggaaggtggaggcttggtttgcaggggcagacagaagagaccaggcacaaagtgaccatgcacgtctttgtgttttttttttggcttcactaaatgtgaggcttgtgagatcttagtccccgaccagggatagaaccctggccctctgcaatgaaagcctctctgcaatgaaagcacggagtcttaaccactggtccaccagggacatccttgcatttgcagctttgatagagatggccacactctcgcccttacagctgtagtggtttgcacaacctcttgcagtgtgtgagaatttctgcttccccacaaagaaagagcttgtagggaatgataatgataaataatgattatgataatgataactatcaagctcttggatttctgaaaatcaaattcatgccaaaattcaaattcaaaattcaaattcaaaatcaaatgccaagttgtcttcagacttatattaattctgtacttctcttattctaagtaagaccgagcatatatggcagaggtgtttccttttgagttaactgtctatctttgagtcgttgcttttttttttttttacattgattcttaaatttttgttttggaatataaatgctttacaatgctgtgttagtttctgttgtacagtaaagtgaatcagttatacgtatacatatatcccctctttttaagacttctttcttcacatcactttgaaggaactttttaagtacgaggcaaactggccctctgtgatatgagtcacatctttttttatttttctccgccattgtcacttgtcctttgatttgcctgtacggctttttttttcttttttaacggaaacttctgagcttttagacttaaaggtattttctttcttagcatctgcattttgagtaagttagtcttcttcactccaaggtgagaaaggaagtcttgaaacattttacggagcccccagtcggtctcattccttctctcccccagatctctgtctccatccagactactgggtgttctcctgtccccgcaaacactagggtagcaccaagccccaagtcaaagtgaaaaatgacccccgagtagcagacgtgaattcaagctaagaatacattaaaaagtcccctcgactatcacgctatcaagcccaaagactccaagacaaaattgccacctgccacccatgagctatccaggcacctcaacttttcccgtgacatgtgcatgcttggtagtgtctgactcttcacgacctcctgaactgtagcccaccaggctcctctgtccaagggattctccaggcaagaatactggagtgggttgccatttcctcctcgaggggatcttctccacccagggatggaacccacaacccctgcatctcctacattggcgggcagattctttaccactgagccatctgggaagtgtaccatcattagaacaaccacagagatgtctttatgacatgcgatgttatctgccatcatcactcctcagcagagggcttgcctggtcgtggatgttctctagatgctgggagcaccaagaccgtggaataccaccttgggggtgactcgcttcttcctgaccacttgtcctgtggcctctggtctctctgttttgttctgatggcggcacatttctgcccttgttctgcctctgcagaagcttccctctcctcagcagttgaaagtacacacacacaaccacacaactagaatccctctctcttgctctgggccacaggacgttgcctccctttctttgttcctggtgactcatactccactgccaattagatttctcatagcagattcttgcttccttggaaaatctaatttcccatcttggcatcccgcctggaactgttcatgaagctctttaaaactttctgactccaagcagctcagccttcctaaagctctggttactcttatctctgcagccagagccggcttcagctaccctaggggccctgcacacaagaagggtcccacccttggtttattgctctcctgtggccatcttgaatcatggtgcattgatgccctcctggcgtgtgtgcagggaggctgggccaggcagagtggaagctatccctggcccgccttgcctagtgggtggctacctggtctggcgggagctaaatgtcaaggtcagtcttgatcggggtacatagcagggccaggagcagaggtttaaagactcttcactgtctgccagcatgctatgggttgggatggcagatccttggaaaggggagactcagggtttgccttgtccagagtccatctcaggctggtggctagcagttgagggttgtgggcagccttcaagttcaagtgcatgtgtgcccagggctgccagggcagaagggtccccggcagctgtgggcagtggcactggccctggctgtgtgcccatgggaaccctctcttcctctttgctcccctcctgagtctgggcctgagtttactgcttccacctacttctaggaattctcccaagatgtgctaggaaatgccaactctgtattattatttggtgattcaccatcaggcttaaatgcttttatatttgcatttagatctagtttcagtttagtcactcagtcgtgtccgactctttgtgaccccatggactgcagcacgccaggcctccctgtccatcaccaactcccggagttcacccagactcatgtccatcgagtcagtgatgccatccagccatctcatcctccgtcgtccccttcttgccccgaatccctcccagcatcagagtcttttccaatgagtcaactcttcacatgaggtggccaaatactggagtttcagctttagcatcattccttctaaagaacacccaggactgatctcctttaggatggactggttggatctctttgcagtccaagggattctcaagagtcttctccaacaccactgttcaagtggccacacaagtgtctcgctctgaactctgagccacaaatcacacctgctctgaacctcctatcaccacgaccccctctcccttcctcccgcccccaacagtccttgtcactgatccccagacaaacactactaattttcaaggcccagctcaaacagatgctactgtggcaaagtgactctttgagttccaactcctcctaacaaagacagacagacagacagacaaccctcacagaacttgctgcctgctattctccgggtagagagcagaactgtgttgtttcttctgtccggcacagcctgacacctggcacatctttgctggtcagtgaatgaatggattcagaaaaactctacaaataaaatgacatatatcccccctccccctgaaattaaagaaaaatacaaaaaagcacaaagaagaaagtaacaagcatctttgtttttactaccgggcatcaaccattgttaatgtcttggcatatttgtttctggtttacttcttgttttggtaagaatagttcaactcactcattaaaaaaaaataataaaaataaggcataaaagtaaaatctcagtatccagatagttctatcatttacattaatgaacaacataatcccagagatctttctatgtacacacgcagcacacatgcagcacacacacacacacacacacacacagggtatttttgtctaaatttaattttacttggaaaaaaactgaagcaaaggcagaacaattgttgacatttcaattattttcataagaaagaataactccctaaaatatccctccaaagttaaaaaaattacaaaggcattggaagttggaatacaatattcacatctctgtttactgatccacgccttcaaagatgagaactatagggcccactctcatatttccttccatcttcctcttctgcccctacctgatcactttttttgtgtgtgtgtgtacctagagttgcgtaataatcacattttattccacaatttccaaagatgttttatattaattccacatttacataaatactcatcaacagtccttttcttttttttggctgtgctgggtcttcattatggcacttggactctctattgtggccaacagtcctttatatcatgagttcttggtgcctgagttctttactttgacttctctctttatttactatttgctggattttattctccagcagtttgttttttccataagggctcatgggtgctgaatttcctttgttcttttgaagaagcccctttctgttgactttcaatctgaatgacatcttctagctagatgacacaccctcttgggaaaaagtttctttccctagaacttttcccttggaaccatcgtcctctggcatctagcacagccctggagacatctgagagcaacttgatgtgatttttctctcctttatttactcttttttcaattcctaaataataataattcttttcctttgcatttaaactactgaagatactaagcattcctatatgaaaatttcctggaaaatgtcatgctcttttggcctaaagaccattttttcttcatttcaataaaatttatctcatttttgtttgcattttcagtcccatttgttggtttcactatgtcaggaaactcaagtatcctaatgcctgactgtgctttatctgtcttccacatcggattcttaataaatgacttcacgtttgtctctgaatttttggaattaagagcctttcctctgttaaaatatttttactttcagcaggatctattctattttttcctcttttttcttctgtaatatgtttcaatgatcttcagtgtattcctgtaagtctgcaatcttcttttcatctcaattaaaatttttcttatctttgagtttcttttattgaattcatatttttaaatcaatttttgaaggatctaaagctattgtggtggttcagatggtaaagaatttgtctgcaaagcaggagacctgggtttgacccctgtgttgggaagattcccctggagtaggacatggcaacccactccagtattcttgcctggagaatcccatggacagaggagcctggcaggctttagtccgtggggttgcagaagagtcagacacaactaaacaactaaacaacaacaacaacaaaaagctattgtaaaaaatggccttctgtcccaagagtaatattttctttttagtaagattcctgcaagctatcattggtggctcaggtggtaaagaatctgcctgcagtgcatgagaccggggtttgatccctgggtcaggaagatcccccggagaagggaatggctacccactccagtattcttgcctggaaattccatggacagaggagcctagtgggctagagtgcatggagtcacaaacagtcgaacacaactgagtgactaatcctgcaaattatcatattctttcctttcttttttttcacaccatttctgcttacctcattcatactttgattcctttgtctcctgcaattgtgatacagtggagtgaaatcctgacctccttttaaaaactgtgcctgattccagtttgttctgtgaagcctgggcagcttctctagcccaaggcataggtgctgggatgtgggcgcgcctatcaaggaagtgtagtctgggctctgcttcctcctggaacacccggttaactgtcctgcaggcatggtcgaggaggggtgggtcaaccatggggcctttgtggggtcccctgactctggtgctggcttctcctgtcctgtacagcaccccccgccccaccccaagtatatttccctcccacccctgagcagaaagcgcctgctgctcctttgtccgaaaaggaaacagcatgtatagatgtgagagttggactgtgaagaaagctgagcgccaaagaattgatgcttttgaactgtggtgttggggaagactcttgcgagtcccttggactgcaaggagatccaaccagtccattctgaaggagatcagccctgggatttctttggaaggaatgatgctaaagctgaaactccagtactttggccacctcatgtaaagagttgactcattggaaaagactctgatgctgggagggattcggggcaagaaggggacgacggaggatgagatggctggatggcatcactgactcgatggacgtgagtctgggtgaactccgggagttggtgatggacagggaggcctggcgtgctgcgattcatggggtcgcagagtcagacacgactgagcaactgatctgatctgatctgaagtcatgctaaaactcatggtttcgttctttcttatttattagggaacacttttaggatttttgtggattccctaccatttttttttctggtggtcggatacactcaaattttaaatatatttaaaaaaacctcagaattaaaacaacagtgtttcagaaaaacaaggtttaagaataactctcccatgtaccagtttgttaaaccctggctcatggggatactgaatgaattcattttcctgctggttcttgaaaagattctcaatggttctgaactactccctacccaacatccatccatgtctctctctccctctctctttccctctttcatattctccttattccacttcttaccacccttactttggccaactgctctcccagcaaactgttttcatttattcttcctgaactgcacaccaccagtttcattctttgaagcaatgaaaagttctcagggaaaagtatcatcaagctctgccaagagagcctatctcacaaattataaaacacacacttccttctgacatctgaacatctgtgagatcagggtgctctgtatggtggcatcacataccataattgacagtggtttttcctacccagtgacataaaagtttttaaagtacaccttatatccatcattgtgtcttacttttggtaaaatatgattggccatcaaagaatacacatgcttcagactacaacagtttgaagatttgtaaatgtcacaggaagtccaacatgctctgtgtatgcaagtggaggaggatggaaaatacattttaataaaagtttcactttcaagacagtacctccaggcaatgattcttcctctattttttttttttttttttttaaggtaaattaccaggtgtcacatttccggaaccaaatctcaggcagattgtctttaagtttgaaataaatacatgagaaacattagaagaaatacaggtaaggataaaagagtcacacagatttttgatgatccaactcatggactagagaactctgaagttcactttctgccacaaagaggtcaaatcttaccaactaagggcacactgatggatgttttctttagagcaaattttgctgcggttttgctttcacccctgtcctctcccagtcaggacagcaggaggcgggtactttgaaacctggccaagatgcggggcaggtggcagcccagttggtctcggggtcagtttgcctgagaccaggagcgggtaggcggggctgggactccaggactctggcagcacctgcctccgcaactcctacctcgttccactcagtttctaagacttttttttttgccaaacaaatgcaaggagatcaaacaaatattaaaagagaaagagaaagagacacaaagagagacaggatagctagagttcctcacagccatcgttcgctacgttaagtgggttgaaggatccaactcctaactgggtttaactggttccatcggtcagagtcgaaacgtgaagcgtcgactcgcacccggttcctcactccctcccgaccccggacgcgggtccactcctgtctccgcgacgctgtccatcgccctgtccccactccagcttccaagcgatgggtttgtaaggccgtaggaccattcagcttcgggggtccctccgtactcctctccggcgcggggacaaactatgcctaaccttgtgttctgctggagggcggacggaagaccccgaaccggagacccgagccgttaacccagttttgcagggcgctgtggaccctaaggaatttgactctcacctctaagcggccagggcccttgtgggaggtcaggtgcgggtccctgggggctgcgtggggggcgatgaacggaggacgcccggacagggccgagggcagcgcggccgcaggggacagtcagtggatgctccccaggaaccctccagggctgcggggagcttggagaggggacgcccccgggcaggggtgcggtgtcgcgcgcggaaaaaccctgcgatccggggcgcaggcggtaggaggagtcccgggcagataggctccaggagagggattccgggaaacggcggcgcagagacggtgtcgcccggtgccctccccagcctcccccgcaccgtgatccccgccgcccacgccggcccgcgttaccttggcagtgtggcctcgccgctgccctccgggtgccagcctcgggcccacccgcttcagccggactccgccgccgcccctccgcaccccggctcggcgctcgtgaccccgatgcgggctgctgttggccccttccgcagggaccgccggcgccgggcaaagggtagcagaaggggagtaggggtggcccgcagcctccgcacccggggcgccccggatggatctcggggtctccgcccagagaggtggagcaagtctccggcgctggtgcgcgcgcccggctgctttcggataccgcgcgggcggagccaccggggcttatactttacccgcgtgtacaccctggggccagaatgatgtctgttcctttccaaggcaaaccgttccacatcacagtaatccaaatctatgccccgaccagtaaatgctgaaaagctgaagttgaacggtcctatgaagacctgcgagaccttctagagctaacacccccaaaagatgtccttttcatcacaggggactggaatgcaaaagtaggaagtcaagagatacctggagtaaaaggcaaatttggccttgcagtgcaaggctaatgaagttaatagcagggcaaaggctagagtttttccgagagaacacacaggtcatagcaaacaccctcttccaacaacacaagagaagactctacacatggaaatcaccagatgatcaataccaaaatcaaattgattatattctttgaaaccaaagacggagaagctccatacagtcagcaaaaaacaagaccaggagctgaccttggctcagataatgaactctttattgtcaaattcagacttacattgaagaaagtagggaaaaccactagaccattcaggtatgacctaaatcaaatcccttacagtggaaatgacaaagattcaaggcattagatctgatagacagagtgcctgaagaactatggatagaggttcatgacattgtacagggggcagggatcaagaccatccccaagaaaaagaaatgcaaaaaagcaaaatggctgtctgaggaagccttacaaatagctgagaaaagaagagtagctaaaggcaaaggagaaaaggaaagatatacccatttgaatgcagagttccaaagaagagcaaggagagagaagaaagccttcctcagtgatcaatgcaaagaaatagaggaaaacaatagaataggaaagactagagatctcttcaagaaacgtagagataccaagggaatatttcatgcaaagatgggcacaataaaggacagaaatggtatggacctaacagaagcagaaaatattaagaggtggcaagaatacacagaagaactgtacaaaaactgtatcatgacccagataaccacaatggtgtgatcactcacctagagccagacatcctgcaatgtgaagtcaagtgggccttaggaagcatcaccacgaacaaaggtagtggaggtgtgatgaaattccagttgagctctttcaaatcctgaaagatgatgctgtgaaagtgctgcactaaatatgccagcaaatttggaaaactcagcagtggccacaggactggaaaaggtcaattttcattccaatccccaaaaaaggcaatgtcaaagaatgttcaaactacctcgcagttgccctcatctcacacgctagcaagttaatgctaaaattctccaagccaggtttcaacagtacgtgaacttcctgaactgaactgaacattctgggatggctcagccataaagaatctgccggcaatgcaggagccatgggagactttggatccctgcgtttgaaagatcccctggaagaggaaatggcaactcagtccagtattctcacctggagaatccaacagacagaagtgcctagcaggctatggtcgagtaggttgcaaagagtccgacatgactgaagcgacttagcatgcaggcacactttactaagaccatgccttctgcccccacccatgtaagctctatagggaaagtttagttcagtcacttagtcgtgtccaactctttgagaacccatggactacagcacgccaggcttccctgtctatcaccaactcctggagcttgctcaaactcaatcaagtcagtgatgccatctaaccgtctcatcctctgtcgtccccttctcctcccgccttcactcttttccagcatcagggtcttttccaatgagtcagttctttgcatcaggttggccgaagtattggagcttcagattcagcatcagtccttccaatgaatattccctttaggattgactggtttgatttccttgcaatccaagggactctcaagagtcttctccaacaccacagtttaaaagcatcaatgcttcaccgctcagctttctttatagtccagctctcacatctatacatgactactggaaaaccatagctttgactagatggacctttgttggcaaagtaatgtctctgctttttaatatgccatctaggttggtcatggcttttcttccaaggagcaagcgtcttttaatttcatggctgtagtcaccatctgcagtgatttgggaacccaaaaaaagagacgaaggattttggcggttgtatcctcaggggctaggacagtgcacttagaacaatgcactcaatttaatccattcaataaaaatgtgttgaatgaatgaataaaagagtgaatagtgaaaaaaagaggtaatgaattctctcctgcactcctcccccacaaagttctacaaaactgctcagatcataattttccaatcaataaaactgggataaaaataccattgagttgtaaaggcttggtatagttccaggctcaagcagtcctgtgtctacattgcaactattggctccccattctctgtgggtcttgccccttgacttctggttgcctatcgaactgtggtgctagagaagactcttgagagtcccttggactgcaaggagatcaaaccagtcaatcctaaagggaatcaaccctgaatattcattggaaggactgatgatgaaggtgaagctccaatcctttggctacctgatgcaaagaactgactcactgggaaagaccctgatgctgggaaagattggggacggaaagagaagggggcaacagaggataagatggttgaatggcatcactgactcaatggacatgagtttgagcaaacttagggaggtagtgaaggacagggaagactggtgtgctgcagtttatggcattgcaaagagtcagacaagacttagtgactgaacaaccactgatcaatgtgtttgggggcaggtagagaggcaaggcagtccctcattgttttgtttacctattatttatatcctgtcaatttccaaattagaatatgaggtaatttacaataaaacacatgtatattttaaacattaaagctgctgctgctgctgctgctgctgctgctaagtcacttcagtcatgtccgactctgtgcgaccccatagacggcagctcaccaggctccgccgtccctggggttctctaggcaagaacactggagtgggttgccatttccttctcgaatgcatgaaagtgaaaagtgaaagtgaagttgcttagtcctatctgactcttagcgaccccatggactgccgcctaccaggctcctccatccatgggattttccagtcaagagtactggagtggggtgccatggccttctccgaaacattaaggctactgaaatgtaaatgttaaaatccttttgaaagagaaggaaaaaatatacttactatattggttattctaattgagcattcactttcactttcagctttctaacaaaggtgtttcatattttgtagataattaaaaggaaaattttcatccatcaaataaactaacatttgctaatgcctctccatatgaaatgcacagagatgatcataagaggatgtcagaatgcgactcagagaatcagtggacaaggaacagaagcctcaggaaacaggaaagcaaaccatacttgactaatagcttgagagtcagaaactccttgagacccagttttagtggagtccttgtgctttcttgagcttttttcacaggtgtcccaccaggttctcatggtgaacaacagagaaagcttccttcctatttggccagagggagggtttgatcctgggttgggaaggttcctctggagtaggacatggcaacccactccagtatgcttgcctggagaatcccgtggacagaggagcttggtggactacagtccagggagtcaaaaaagagttggacacagttgagtgactatacaacagcaacaacaacaccagtttgacccagctcaaagacagttagacaacccagtccctgcaagcttttctgacattaggggagaaaaaaacctagcagggcagaggctaggaagctcctctgaaggtcacagtccagaggttcaggctcattaaaaagagaaacaggctctgaaatttaactttgaggttactgaatgtttcccctccacaaaacctttcaccacacccataggactccagtggattacaactctatttaagaaggagcttgtagggaaacccagaggcaacggggaagacaaaacacgaggacacgggataaaatgaaagcatcagacacctataggtgcagcaaacattaaacaacaaactcttagccagataagcatggtgcttcacagtgaatgattatttatctcagctcctgttatctgacacatcatgtccagctctctacaaaaagtatgaggcatgccagaaggcaggaaaacacaatctgaagagacaaagtaggcttgagaaccagactaggattgagaatttggaattcttagcctaggtgggtacatgatattgcaccttcatcaaaacccatagagctgtataagacacatagagagttctaatgtgactgttataacatgtggttaataccaatgtatcaatattggctcatcagttctcacaaatgtaccacactagtgcaagatgttaaagatggggaaactgtgtggaggggaaggggactatgggacctctctgtcctatatgatctgtggaccaatgtttcctcccatttttctttaaagagacagccttccctgggttttggggttttttttttttgtaatttctgttaacatgtgcatgctcaattgctcagtcatgtctgactctttgtgaccccatggagcctggctcctctgtccctgggattctccaggcaagaatgctggagtggcttgccatttcctcctccaggggatcttcctaacccagggattgaacccaagtttcctgtgtctcctgtactggcaggcagattctttacttctgagacacctgggaatccccagtatatgctctatattcctataaagtctactatatgtttaaaaatacacatttgttcatttattcaggaatattcactgatgccaagccctgttgtaagtttcagagacagcacagaacagtcagtcccctacatacaaaccttcaagctgtgaactttcaaagactcaaatgtgtgttcacatgtctagtcatatgtctggtatatgttgctgcatgattgtgcttttttgtgcttcactgtacagtactatagcgtatagtaatacactatgtttatgtcaagcccaggatgcctggaagcgcttgtgaaagcagtggggatgtagccagtacttctgtaattttcaaggtactgtcagttcagttcagttgctcagtcatgtccaactctttggacttgccgcgaccccatggactgcagcacgccaggcctccctgtccatcaccaactcctggagcctactcaaactcatgtccactgagtcggtgatgccatccaaccatctcatcctctgtgatccctttcttctcctgccttcaatctttcccaacatctgggtcttttccaatgagtcagctcttcacatcaggtggccaaaaaattggagtttatgcttcagcatcagtccttctaatgaatattcaagactaatctcccttaggatggactggttggatctccttgcagtccaagggattctcaagagtcttctccaacaccacagttcaaaagcatcaattcttcagtgatcagctttctttagtccaagtctcacatccatacatgactacgagaaaaaccatagttttgactagatttgtagattttgactacattactttgttggcaaagtaatgtactgtaagactaaaaacattttctttgtttttatatgtgtgtattttttgttttttatgtacctaggctaactttgctggacttacccaagcaaactggacttacaaatgaacaggattcatccgtacgtaggggacttaatgtatatgacacaggctgagttcctgctgttctctgggcttatgttccagtgggtggggaagttggggtggtggtggtacaaactctaaacaaacaaaaataactgcagttttagatttacagtaagtctccttcaagctgcaaactttcaaagacgtgaacgtgcgttgccacctccaatcacatgttagttcgtgtgtctggtgtgcaccgccacgcgcgtgcacctcctacaagtggtggtgctctgtgtgctttcctgcacagtattgtacagagcgggcttccctgctggctgagtggtaaagaatcctcctgctcatgcaggagacacagtttggatccctcgtctgggaagatcccctggagaaggtgatgggaatccacctcattattcttgctgggagaaccccacggacagaggagcctggtgggttgtggtgcatggcgttgcagagtcagatccgacttgtgcctgaacaagaacagcaactgtatagagcacagaagtgcagagtctttatgttgagcccagaatgtccagaagcaagtgtaaaagcagtggtgatgtagcgggcacttttcagagtaccatactgtaagactaaatttttttctttattttttgtgtttatttttttatgtattatttatgtgaaaagcatcacaaacctatcatagtacagtacgttaaagccaagggttagttgggtacctagactaactttgttggacttatgaacaaattggacttaggaacaggctcttcagaatggaacctcttatttcccctccctccagtttcctctagtaacatcttgtaacaatgtggtacatgtgttataattgggctgccctggcctgcctgcagggtgggagacctggttggatccctgggctgggaagatcccctggagaaggaaacggcaccccactccagtacccttgcctggaaaatcccatggacagaggagcctggtaggctacgtccatggggttgtatagagtccaacacgactatgttatacttggtgagcctattatgctttggttgatacattgttatcaactgaagtccctagtttatattgggacttactgttcatgctgtaccttttttccctgctgtacattctgtagagttgtaacaaaggtatgatatgtattcatcgttagagtatcacacagaatagtttctaaaagtgcccagtgttccatttgttcatcattttctcctctgtagtcccggcaaccactgatctttttactgtctccaaagttttgctttttctagtatcacatacaattgggatcgcatagttcctagcattttcagactggcttcttttactcagcaacattcatttaaggtttctccacatcttgttgtgacttgatagtaccttttttagtgctgagtaatattccaccatttgtaccacaatttgtttatccattcacctattcaaagacatattgattgcttccagattttggtaattatgaatacagctgctatccacatccatgttttgtggctattaggttttggtgtgaagatttccaactcatgggtgaatgtcaaagattgcaattgctggatcatattttaagagttatgtttagttttgggagaaactaccaaatggtcttccaaggtggccataccatcttgcactcccatcagcaatgaatgagagttttcacttctgcacatcctcacatcttcaccagcatttgctgctgtgagtgtttcgcatgttagccattttagtgggtgtgtagtgctatctcattgttgttttaagggatgggtatttttaagatggggcttcccttgtggctcagctggtaaagaatctgcctgcaatgcaggagacctgggttcgatccctgagttgggaagatcccctggagaagggaaaggctaccaactccagtattgtggcttagagaatttcatggactctataatccctggggtcacaaagagtttgacgcaattgagtgactttcacttgagttcactttgtttttaaggcggaagaatactatatgttttcacagtctattgaaaatggtcccatagagagtggtaaatcaattgtggggaagagataaagagtgagattgttgagataggaggaacattgggagtggcggaggcctgtcttaggtggaggggaccccttaaaggtctttcgtaacaggagaaaggaaggcatagtgggtagacttggtggcaaagataacagagtgcctgacaacttctacaaaaagcagaagttgtcaggcaaagtcatctgctgaaaacaaggtgtgtgaacagggtcatgaaggtggtttgtagacagagaatttctgaacatggagtactcttaacatgtcaaaggcttccagacgggaggggatctgtgaaggatctttcctttcataaaaccccacagccctacacctctctgctctcctcggcgtggggaagagttcagtggaaagaatgggaaatcagggagtcagagaacgggattctggtttcagcctcggtcaagttgactcgtgtggttgaatgctgagttctagcttgggctcggtgactccagaccgagagtctcgatgctcgcccacagtgcactgcgaattctccctcagagctgcacgtgtgagcgtgttgggggtcagttcctcccctgggtctcgggccagaaaccccaagcctgggtagtttgaccacatttagcctctccatgcagctgcccaccttcgcccaggcaggtggaggaagtgaggtagcgaggggcttgcttctttcaacccagctgcaggttgcctccgctaattgttcagagcactgcagcctgacacctcggggccccgtgtgactcgtgcagagtgggcggcctctgtcacccaacctcagctaggggactagaccataagcacatgaccctctttccccacgtctggttctcggagtgaatcatttccttcctccttcaccctctttttaagccagcactaccccctagggcttggctctgtccacacgcacacccttacacacctgcatggggtagtggggtagtatgccggggccctgtggccactgtggttgagtggggttgacatcatcccccaggcttgcttgggaaatgggagccaccaaggctggaaaggaaagaaaaaagaaagcggggaatttgagacaactcgctcatctagaacatgctgatagaccacgtgattcctaaagactcctgagactttgtattgtggcaatgaattaattttgcatatgcattactaaatgtatcatttagtgaattactacataaatgaaatgtagattgatttttttaaagcctaaacctcattgttttctcatgtaccctaactctcccaatggctcctgaccatgtgttgggagaactctgtgcacagaaagctgatggatatccaggagaccctgcctttctaggagagaagcccaggaagacagggcactcatatgaggctggcagatcaaggtgcctggactcaatcctaggtcccagggagaattccatcagtgttcacagagggaggctataagaaactccaagacagggacttcttccctggtggtccagtggctaagactctgctcccaaagcagggggcccaggttggatccctggtcaaggagccagatcccatggactgcaactaagagtttccatgctgcaacaaagatgaaagatcccaagtaccacaacaagacccggcacagctaaatatataaataagtaaatagtaaaaaagaaaaagaaagaggccccaagacaaatgctatgagccctcttgatgggcttagtgccctcttaagaagaagaaggggcttcctgggtgactcagtggtaaaggattcgcctgccaatgcaggagacatgggtttgatccctggtcgggaagatcccctggagaaggaaatggcaacccacttcagtattcctgcctgcgggatcccatggacagaggagcctgcgggcagacatggggttgcaaaaaacctgggcccgacttagcgactaaacaacaagaagagaaagactttccccagcaaccgtactcatcagaacctggattgtgggctgccagcttccagaaccatgagaaataaagacgtgctgtttaaaccattccatctatggcatactgttataccagcctgagcagacttagacatatagttttaatataattgaatttcccagaaatgtaactgctgtgtaaattgagtgaagcttgtgctttgttttgttcagaactttaccatgggttctccactctggaaacacacaccaataacaccatttgtgatgtctgagtcagtgagagatcacgcctgtttcaatttgtgtgacagccgtggccttcgtggtgagtccagagcaggaaattagcacaatccagtttacagactaacaagttctctccttgctgtgtctaggacagatctaaagaaggagagactggatgcagagtgcagtgcagaggttcttgctggaccaggattttggcagtagggatggattagaaatattaggaagaagaataaatagaactgggtgctagattgactgtgtggactgagggttacattagaagacaaggcaaacccccagcatcctagattagacatctctcgtttggtggtgccattttcttttcttttttaaacatttttattggagtatagttgatttacagtgttgtattggtttaggtatagagcaaagtgagtcagttaaacatatacatatattccttcttttttacatattttcccattaggtcattatggaatattgagtagaattccctgtgttaagtcgtatctgaatctttgtgaccccatggactgtagcctgtcagactacctgtccatggggattctccagaaaagaatactggagtgggtagcctttccctcctccagggaaccttcccaaaccagggatggaacccacatttcccgcattgcaggtagattctttaccatctgagtccccagggaagcccttgggctctacagtatgtctttactagctacctattctgtatagagtagtgtgtatatgtcagtctccacctcccaatccatccctcccctcacttgccacccctggtaaccataggtttgttttctgtacctgtaacgtctgcactgtttctgttttgtaagttaattcactggtgccattttttagattttacatgtatgcagtatcacatgacattcatctttctgtgacttacttcactcggtatgacaatctctagatccatccatgtcggtgcaaatggcattgttttgttctttttttgtggttgagtcgtattccattgtgggagaaggcaatggcaccccactccagtactcttgcctggaaaatcccatggatggaggagcctggtgggctgcagtccatggggtcgctaagagtcggcacgactgagcagcttcactttcacttttcactttcatgtattggcgaaggaaatggcaacccactgcagtgttcttgcctggagaatcccagggacggggagcctggtgggctgccgtctatggacacgactgaaccgccttagcagcagcagtattccactgtatgtatgtaccacatcttccttatccgtccctctgtcagtggacatttaggttgtttccgtgttctggttactgtcattagtgcttcagtggacattggagtgcgtatatcttttcaaattatcgttttctctgtatatgtgcccaggaatagggttgcagcatcatatgataactctatttctagtttcataaggaacttccaatactgttctccatagccactgtaccaatttacattcggtggtaccattttctaagatggtacgtgtgatggttaaggtacccaggctatggtgggtgataaataaatgttcacatagtgagatatacggaagtcattctgacttattcatgagttatcttgaattttatgctgactaaaacaatctgtttgtggtctatcaaacatacattgtacatatgctttaattattagagaaaagggcatcagaaagaaaaactaaagaatgtccatgttaagaataaagacgaaatgcatctcatcccaggacaccaatgctggtgctcctttgatgctaagacaaccttcccaggtgccaaggccaggctgacttgctgtatgtgtgctcatctgtgtgtgtgtgttttaccttggagaaatatacccctaatttgtttaatctcctttgctcagacaagatataagactgtgctgaaaaaccaggcttctctggagcagcttctcagattaatctaggaaaatagtttccaggctagtctttgatttgactcagaaaactcttttctattcttattatagattgttttttgattattcacataggtcatggtacctagctttacattaaatctcagtctagatatagtatgaaggtacttttaaagatgtgattcatatttaaatcagtagactctgagtaaagcagatcaccctccatcatgaggatgggtccaatccagtcatttgaaagccttaagaggaaagactgaaagtcccttggggaagaaggaattctgcctttagaatgctttctcactcaagcggcaacatcatctcttccctaaatctgcaggacaccagcctccacgatcactagaaccagatcaaaccagtcaatccaaaaggaaacaaatcctgaatattcgttggaaggactgatgctgaagctgaagctccaatactttggctacttgatgcgaagagcctactcattagaaaagaccctgatgctgagaaagactgagggcaggaggagaagggggtgacagaggatgacatggttggatggcatcatcatggacaggagcttgagcaagttctgggagacagtggaggacagaggagcctggtgtgctatagtccatggagtcttaaagagtcaaacacgacttattgtctgagaaacaacagcagcaatggtgtaataagggcaaccgatgccccgagagcaaatgggctactccagagagacgagggagtaggacccagggacatgaagacagagccacaagcaacatttaacatgtaggggacagcagagaaagttgagcctgtggatgagacaggagaggagagtcagggagatggcaaaaaaatcagggtgctgtcccagctgccaggggaagaggatgcacagaggaagtggcccagagttaaagggcaccaaaatgtcaggagagtcaggcgctgagcagtctcctgtgacctggcggagcacacgtgttgcccagtggagggtgagagcgtgggcttagggccgagatcgagaatggaggggaccggtttgcgagaagttttgctgggaaggcgtgggacggagctagtgctgcaagtgttggctgtagggaggagagaggtccggcttcactcttagcctttctgtcccccaaatgggagagccataagtgtatttgaaggttgatggaaaggatgcagaagcactgggaaggcggaggcaatacaaaaccagagagcctgaggtctgagtgcgtggaagtgacagccaatctctccagatatgttcagactaggggttcctacgctggtagtaaagaacccgcccgtcaatgcagtagacttgagactcaagttcagtccctgggttgggaagatctcctggaggacagcatggcaacccactcccgtattcttagactggagaataccatggacaggggagcttttctaagaatcaatgctaatttcctcttacattttggaagttttccagggtgatgagtttgtcttgaagaaatcagtcactgcttctttgatgctatctggaaaccaagggcttcccctgccctgcttttttattccacatgttctttcattttaaaagtattctttcttttctgcttcattttaaattagatccaaggtacactgagtgggaataaataatcataatcattcagttcagttcagttcagttcagtcgcttggttgtgtccgaccctttgtgaccccatgaactgcagcacgccaggtctccctgtccatcaccaactccagttcatgacattctcttatcatgggtccatatttgtcctgcttcaaatcaattaattattttattttgtttttagtatttatccagtttcattgagatataattatcgtacaatgtaagtttgctgttgtttagttagtaagtcctgttcaactctttgtgaccttgtgaaccacagctttccaggcttccctgtccttcactgtcgccaggaggctgctcaaatttatgtcagcttagttggtgatgctgtctaaccaacacaacctctgccactccttctcctgtgctaagtgtcttcagtcgtgtccgactctttgcaactccatggactgtagcccgccaggctcccctatccatggaattctccaggcaagaatactggagagggttgccatttccttctccaggggatcttcctgacccaggaattggacccaagtctcctgcattggcagacagagttctttaccactagcgccacctggggagttccaaaatgaaagtgaaagtcgctcagtcctgtctgactctttgcgatcccatggattagttctccaggccaaaatactgaaatgggtagctttttctcttctccagcagatcttcccaacccaggaatctaaccggggtatcctgcattgtaggcggattcagtccgccttctcctcctgccctcaatcattcccagcatcagggcgttttctagtgagttggctcctcgcattaggtggacaaatattggagcttcagcttcagtatcagtccagcctttctaatgaatattcagggttgatttcctttagaattgactggcttcatctccttgcagtctaacagactcctgagagtcttctccagcaccacaattcaaaagcatcaattcttcagtgcttaatcttctttatgatacaactctgatatccatatatgactactggaaaaagcatagctttgactagatggacctttgtgggcaaggtgatgtctctgctttttaatacactgtctaggtttgtaatagcttatcttccaaggaataagcatcttttaatttcatggctgcaatcacaatcggcagtaattttagagtccaagaaaataaaatctgtcactgttttcactttatcccttctatttgccaagaagtgatgaaatcagatgtcatgaccttaattttttgaatgttgagttttaagccagctttttctctctcctcttgcactctctcctcttccttaagaggctctttagtttcttttgctttctgccataagggtggtgtcatctgcagatctgagattattgatatttctcccatcaatcttgattccagctggtgagtcatccagcccagcatttggcataatgtacttttgcatataagttaaataagcagggtgacaatgttcagtcttgatgtactctttttccactttagaaccaatcagttgtgccatgtacgattctaactgttgctttttgaccgacatacaggtttctcaggaggcaggccaagtggtctggtactcccatctcttgaagaatattccacagtttgttgtgatccacacagttaaaggctttactgtagtcaatgaagcgaaggtagatgtttttctggaattgctttgctttctctatgatccaactaatgttggcaatttgatctctgattcctctgtcttttctaaatcaacttgtacatctggaggttcttggttcacatactgatgaagcctagcttgaaggattttgagcaatactttgctaacatgtgaaatgcatgcaattgtgtggtagtttgaacattctttgccactgtctttctttgggattgtaatgaaaactgatctgtttcagtcctgtggccactgctgacttttccaaatttgctgacatattgaatacagctgaaactccagtactttggccacctcatgtgaagagttgactcattggaaaagactctgatgctgggagggatggggggcaggaggagaaggggacgacagaggatgagatggctggatggcatcactgactcgatggatgtgagtctgagcgaactctgggagttggtgatggacagggaggcctggggtgctgcaattcatggggtcgcagagagtcggacacgactgagcgacttaactaaactgagtgcagcactttaacagcttcatattttaggatttgaaacagctcagctggaatcccattacttccactagctttgttagttgtaatgctttttaaggcccacttgacttcaagctccaggatgtctggctcaggtaagtggtaacaccattgtggttatccaggtcattaagaccttttttgtattgttcttctgtgtattcctgccacttcttcttaatctcttttgctcctgttaggtcgtcacagtttctgttctttattgtgcccatccttgcatgaaatgttcccatgatctctccaattttcttgaagagatctctagtctttctgttgttttcctctgtttctttgcattgttcacttaagcaggctttttatctttccttgctattctctggaactctgcattcagttgggcggatctttccctttctcccttgcctttcacttctcttgttttctcagttatttgtaaagcctcctcagagaaccactttgccttcttgcttttctttttctttgggatggttttggtcacagcctcctgtacgaacctccgtccatagttcttcaggtgctctgtctatcagatctaatcccttgaatctatttgtcacttctactggataatcgtaagggatttgatttaggtcatacctgaagatctagtggttttccctcataaaacatggtccactggagaaggaaatgaccaaccactccagtattcttactttgagaaccccatgaacagtatgaaaaggtaagatgagaatagcaggacaattgagagaggaggctgggcactgcccagaccacatatttctcattcttgagaagccagaagacctccccgaccacacatgcgcagaagggctccttggaggtcaaaaagggagggatgtcaagtgatgctaagctacccacaggcctttgcagtaatatccactttggctaagagcggactgcacacatgggatgatcttgagatatcccaaatatgaactgtgaccagggcaaatcaaaaatgattcgccaaaggaaatctggaagaaatgccccataaaagtaattcaaacagccacaagggtgcgattcagtgactctctctccgagtctgcctgtatgtctatccacacgtactgtacactttttcctcctaatatttacttgcttccctactttctgtctttgtggactttttttcctgcagagctgaggggccaaggctctcgtcattgaccacaggtctaatggctagaatttggtactctaaccaccaagactaggccttagtctctggctgggaacccaagccccactggaagctattttgggctgaggccaccagagattggtcccaaggtcagggtgcctgatgtgggcagagccgcttcactcctcagggagaagctctgttatttgtgagactccgtcctgacggtgggtctccgcaccaagcgtggggattttggtgagaccacatccttgcctctcccaacttcttgtgccttgtttaccctttgttgtggaggagttgttcagccagttttcagattttttccaaagggaattgattcatcttcgtctgtaaatttcctgtgtctatgaaatgtgggaagttcagtattttcttacacctccatctttaactgcccctcatcccttatttctcgataatttatttgttgttgttcagtcgctcagtcatgtccaactctttgtgaccccacggacagcagcacgccaggctccttcttgtccttcactatctccctgagtttgctcaaactgatgtccgtttgagtcggtgatgccttccaaacctaacttcttggattttaacaacatctctgtttctgatggaatctgtaatccagtgtttgttttggaaattgttatgcttatcaaatgtcttttgctcttttgacctgtgagctcatttttccatcatgagagtggaggtcggggggagagggcttgaccatctttgttaggcattatctacggaagaaagctggactctagtccacttgccccagggtgataggcagagacaggatcagtcccagaagccatgtcaacccagtcagagtatcaggagttctctaagcattgagggaaattccagaggtggagttcctacatgtttttgagcagtggctggctgcccaaacaggcgtctaagaagagcaaagaatgaccttggcctgcgggcttttgaagtggctctgttgaagcatgaatcatttcatgactgtgagcccagttctacttaggtcggttggaaacaagaggcattgaaaccgttcacctcagattgggacttcaactcatgtgcggggactcaaatccagacagaactcagtttaggactcaaacccacgtggcgaagacctgaactcagccaaaacccacagtcttccaactgagatcacacacctggtttcagggcctaatgaagctcagatccttgaagtcttaccacagaaagaatccagtgagagacaaagagataggcaagaagtagatttgtttagagagaagcacaccccacagacagagtgggggacatctcagaaggtgagagcagccttgaaatatggtgtggttagcttttatgggttgggtaacttcataggctcagtgcttccccctcagggctttcctggtggctcaatggtaaagaatttacctgcaatgcaggagaccgcttttgacccctgggccggaaagatcccctggagaagggaagggcaacccactccagtattcttgtctggggaatccatggacagaggagcctggcctccatggggttgcaaaaagtcagacacttctgagcgacttacgcttacactacttgcaacttcataggctaatgagtgggaggattattccagctccttggggaagggggtggagatttccaggaactgggtcactgcccactttttggtctttgacggctgaccttggaactgtttgcggtgcctgtgggtctgtcatccagcttgctgatgtggtacagtgagcatacaccgaggctcacagtctagtggaagttgactcatccgccgtcttggacccatttggttctaattagtttatgttatgtcctagggctgtgtcagtctttcaaaggctgtatcttacctgcttccctcctgtttcagaatcatctgttggactgaatattttctaggaaaaaaaaatcatcccaaaaccaaagtactgtgctctcgatgagtcatcatctggcagatttagttacagctgtgggagttggatattctctttacatttcaggctgtagtttccagagttgctccactctgtgtttctatgtctgaatcactggatgtgaccgattctctctgtcctgcatttatagtttcacttatttaatagctagtttgaataaaagttatattaatagtagaaacacctcataccagtcagaacttgtccttactacgtggcaaatgtgctattctattccatttcttctttcctactgcctgagactcactacagtgatttcatgatccgctaattgactccaggctgtaatctgtaaaacattgatttggtggaaggcaaaggcaacccacaggcgtgcacgcttagtccctcagtcgtgtccgaccctcgcgaccccatggactgtagcccaccaggctcctctgtccatggaattctccaggcaagaatactggagtgggttgccgttttcctcctccaggggatctttcccacccagggactgaacccatgtctcctatgtctcctgcactgcaggcagattctttaattgctgagccataggggaaccccagaggaaacccacaggccacttcgtgtgagggggtgattaaaaacaaaaatggggagtttacagcttaagttaaaattagcctaggcgaatgtgatgaaggaccaccccccgcccccgccaccaactgtcctggtcagctgggaggctctgcccctgcccattcttggctggggcagccaccgtggggagggggtgcccgtgtgccacagctgtgacccaggctgccctgggagcccagccagccagcagatcaacgttcacctcacagcaacctgtgggtttcctctgcttccttccaagtttgtttttccaaagtctggttcaggacctatttgtgggttatgaaatcaatttagtgagtctcagataacatcagaaaaaaaaaaaaaacaagaaatggagtggaaaatagcagagtacattgtacatagtaaggacaagtattgacctgtttgaagtgcacagtgcatggtgtacatgcagtgagtggtgtgtgtgtgtgtggtaaatggtgtgtgggagtgtgcgtggtatatggcatgtgggaatatgtgtgtatgtgtatgtggtgaatggtgtgtgtggtgtctgtagtttatgtgtggtatggtgtgtgtgtatgtggtgagtggtgtgtggtgtgtgattgtggtgtgtatggtaaatggtgtatgggagtatgtatgtgtatgtatgggtagtgaatggcgtgtgtggtgtgtgcacgttgctgaatggagtttaactgctccctctatctgctgagatgtgtctctgaaggtggattgtgagatggtgtccnnnnnnnnnnnnnnnnnnnnnnnnnnnnnnnnnnnnnnnnnnnnnnnnnncagtgtatgtgacatgaatgtattaggatgtaatcacatgtgactttacctcaagtctgatggggaaaatgttcaagtattggattatgggaagtcattctgtcttacattaatatgtggtttggcctgaactttgtatgaactagaacggcctgactcaaggcctgtcaaatgtacacagcacgtctctaaccatcaaggtcaagaatgtccagtttggtgagaggataaatgacccccttcctatgtgtccatgttaacagtcccctgaagataagactcccttcccagacactagggcccagccagctcactgtatatgtagtaagcagtctcttttttaaaaaaaattaaataaaaaaatttatagcttatacaacatttttctttacgcaacaagtattttctttaaaaaatgttatagggggatttttttcatcggctcttcatacaatacaatccttttgttgaactaaagttatactggcaatgagtatttatggatccaaagcagactggagcttctaatatgaaaaatttagcattcattctatttcaccgattagttgcagaaatgaaacatctgtccagattcacacaattctgtaaaaagttgtctcttttgaaacctcaaaggaatgttccttgtcacgttagatgtatgtcctttgttctgataaggtatgaatttgctgacgaccatgattctacgcatcaatttctcagagctaccaagaggctgcctccagggctaccatcctcagtttggctcaaataaaactttcttctgttccttattagagattgattattgattatttgcaccataaggctagtgaacttgaatttccagggccctagccacttggaaaggctagtccctattttgtatttggaatgccctatcatttttttaaagaggggaaagctttattctcttcaaatgctgggcctgttccagttgtgcagtagcaagctttacttcctatgtgtgcgtgctgagttgcttcagtcgtgtccgattctttgtgatctctgactatagcgtgctaggctcctctgtccatggaattctccaggcaagaatgctggagtgggttgccacgccctcctcaaggggatcttcctgacccagggattgaaccagcatctcctgctttgcaggcagattctttactgctgagccactggagaaccccaaatgaaacataattctcagtttttcggtttgtgcatttcttttcagtcgtaaagccgagggaatgccacactttcaggaacatagctaacaccacgtggagtattgacttgtccctctgctgtgtgcctgccacacagcggtctccagacactcttactccacatgggccttgctgcacaagcctgtcacatgctaagtcctcccttcacttcaacccaaagagccaggaactgctggggaggggctataagacagtttcaaagatgtgttatgttttatacaacacaggaaatatactgtgtaataactgtaaattgaaagtaatcttagacaatggtctaaaatttttaaaaattaaataaaaaatgtaatttaaaagaagattcagatgctgttatcactctcctcattttacagatgagaaaacaaaggcccagagaggttaagtaattggctcaaagtcacacagtaagtagtcaagccaggattctaactttagggtttggctccagagttccctctgtgaccacaatgtagcagacatttgatggttagatgggttgttaagagaacagaaaatgtaaaagctgtacgtaacctaagctgatctttaaagggaaggtttgggtgagccccctggtggcttcctttgtggctcagaagaatccacctgcaatgcaggagacctgggttcgatccctgggctgggaagatcccctggagaagggaacggcttacccactccagtattctggcctggagaattatatgggctctatagtccatgggggcgcaaagagtcggacacgactgagcgactttcacttcacttcacttgggtgagcccccaggtggggtggagaatggtaggtggcctgggggctggggagagctggctttctctgcaagtgccactgtggagctggataggcttcgaggtagcctggaggtgggggagctccaggatggaagatggggctccaatggggtgtgcacagtgtgtgagaagtggggagacggggggcactcggacatcagagaggaacaccccacccacccccctgcagggcactggagaatcaatatttcaaagcacgtgttgtgaggctgtttgctgtggattttgtgatggaaccactgagcccttcatcttctgccatgattctttctgaaatgcttagtaagatgactttggaggcatttgttatccttaagggctttttttgtgtgagcagattgctcagacagagctcagagaactctaaggatgcaggcccagtgggctgacctcaaaggtcatgacagtgacgggcctgagcccaccacacatggacctgcagaggcacggggtcctagccgacttctggggtctagaatgcacggttgagggaaccagccttgactcagcgctcccctctcacttcactggacctgcccctcatcccacagccctgagggtttggaaagactgccctgcctccggacccagactctagtttttcatcttttttattaattaatttatttatattttgggctgtgttgggtcttagttgcagcacatgggatctttgttgtggcaggcgggcttagctgccctgcgggatccagttccccgaccaggaatggaacccttgtcccctgccttggaaggtggattcttaaccactgaaccaccagggaagttccctagctttccatcttttataacaattaagctctacctccaatgtcctgatgtgcccagtaagtacaagtaaccttatggtacaccaagggcacttttagcaaagaatcctaagatcccctggagaaggaaatggcaacccactctagtattcttgtctgaaaaatcttgtggacagaggagcctggtgggctatagtccatggggtcacaaagaggcaaagctgagcagcacccctgcttttagcagaggattgttcttttcaggtcatatttgggatagtagtagtgaaagtgaaagtgaagttgttcagttgtgtctgactcttcgcgaccccctggactgtagcttaccaggctcctccatccatgggattttccaggcaagagtactggagtgggttgccatttccttctccaggggatcttctcaacccagggatcaaacccaggtctccctcattgcaggcagatgctttactatctgagccaccagggaagcccctggtaatggtgtattttgcatgaagtctctgatacatggaggcataaagctgtatatacagaatctttctaatgatgtttgtttgcaatgaactgattgcttagtaagatgactttggaggcatttgttatccttaagataactctttagactgggtagatcacagtttaaaatggcagggtgggacccaaggtgggcctagggaccagttagcttgaccacccaggacacctgtccctgcctttgttccttctcagaggctctaaattaagggtgtattattggactccatttgcctggggagcgagggcgctccattgtaggcaggttgctattgtctaactgcaggatgaatgaggccaccccaggctcagtgaagcttcttgtgtcaccccaggctagccaagcagcagaattgttccagccttagggggagcatgggtagggaagggggagttgggagggaagagagagtccccaagactgggcttgaggatgtccgcagtggcgcttaccaccctggccttaccatctgcaactccccatttggtgagtcaggaacccgactgggcctccacagatgactgccagctgccctgcttgtgtcctgaacttactttcttctgtatctttagatacgggaacttgcgtggctttcctaagagtgactgggtctgggctttatattaatttgagcacaccattgatgcttgccaatatggtggtggggtgaagacctttgacccacaggttcatcattatgggagtaaaaacagcataggtgatttaatttttagaaagcaatgaaaattttaatgcacatatttatttttaatatatattaagtgggcttcccaggtggccttaatggtaaaaacccacctgcaaatgaagtagactgaatagacacaggttcgatccctgggttgggaagatcccctggaggagggcacagcaacctactccagtattcttggcttaagaatcccatggacagaggagcctggcaggctatggttgatggagtcacacagagtcaactgaagcatgcacacatgcatatgtaatataaacaaaatgaatatataatatgtaatatatataacatatggtcttccctggtggctcaatagtgaagaatctgcctataatggaggtgctgccagagatgtgggtttgatctctgtgttgggaagatcctctggagaagggcatggcaccccactccagtattcttgcctgggaaatcccatggacagaggagcctggtgggctacagtccatggggtcgcacagagtcagacacgactaaagtgacttagatgcatccatatgtaatacatatgtaatgtataaagagatatagtttaataatgtattaaaatattaaaattatttttcagttcagttcagttcagtcgctcagtcacgtccaactctttgcgaccccatgaatcgcagcacgccaggcctccctgtccatcaccagctcctggagttcactcagactcacctccatcgagtcagtgatgccatccagccatctcatcctctgccgtccccttctcctcctgcccccaatccctcccagcatcagagtcttttccaacgagtcaactcttcgaatgaggtggccaaagtactggagtttcagctttagcatcattccttccaaagaaatcccagggctgatctccttcagaatggactggttggatctccttgcagtccaagggactctcaagagtcttctccaacaccacagttcaaaagcatcaattctttggcactcagccttcttcacagtccaactctcacatccatacacgaccactggaaaaaccatagccttgactagatggacctttgttggcaaagtaacgtctctgcttttcaatatgctatctaggttggtcaaactttccttccaaggagtaagcgtcttttaatttcatggctgcaatcaccatctgcagtgattttggagcccccaaaataaagtctgacactgtttccactgtttccccatctatttcccatgaggtgatgggactggatgccatgatcttcgttttctgaatgttgagctttaagccaactttttcactctcctcttttactttcatcaagaggcttttcagttcttcactttctgccataagggtggtgtcatctgcatatctgaggttattgatatttctcctggcaataacaaaaccgaaagcaggatggctagctgttaagggctgaattgtatccctccccccaccccactccaccccgctccaaattcatacgtcaaagtccgaacccccaggacgtcagaatgtgactgtgtttagaaacagggcctctgaagaggtgattaagtgaaaatgaagtcagtagactgggccctaatacaatacaactggtgcccaaaaggaggaaattaggacacgcacagggaagcccctgtgaggacacagggagtagatagtcatctacaagccaaggagagagacttcaggggaaatcaaccctgctgacaccttaatttcagacttctggccttcggaacggagcaaataaatgtctgttgtttagaccgcccagtctgtggtacgccgtttgggcagttggccagctaagtagccatcttgttcgtgtctgtagcatcctttaagctagggaagggctccctctgctgtgataaacaccaaatgccctgaaaacaatgcatttcatgtttggacaccatagaattaagaaccaagtatttagatgcttctttacagcatcctttatagaatcaagaatatagaatcctcatcgaattctttacagattccttcacctgtaagttcagttcagttcagttcagtcactcagttgtgtctgactctttgcgaccccatgaactgcagcatgccaggcctccctgtccatcaccaactcccagggtccacccaaaaccatgtccattgagtcggtgatgccatccaaccatctcatcatctgtcatccccttctcctcccccccaatccctcccagcatcagggtcttgaaatgagtcagctcttcacatcaggtggccaaaatattggagtttcagcttcaacatcagtccttccaatgaacacccaggactgatttcctttaggatggactgattggatctccttgccatccaagggactctcaagagtcttctccaacaccacagttcaaaagcatcaattcttcagcgctcagctttcttcacagtccaactctcacatccaaacatgaccacaggaaaaaccatagccttgactagatggacctttgttgacaaagtaaagtctctgctttttaatatgctgtttaggttggtcataacttttcttccaaagagtaagcgtcttttaacttcatggctgcagtcaccatctgcagtgattttggagccccaaaaataagtaggggtgctattaaaatattcagcaactgggggtggggggttttcctattgtgccaggtgtggaggaaggggtggggaggccctggggaaggctgggtggcctgggcagtctcgggaggaagttggggggaaagactatgcaccaaccccttacagaagatgtggccattcggggtgtcccattgaagatcagtttgcaatcacataaaatcttcttctagtacttcctttatgaaactgcaaatctttaacctagttagtgctcctagaaatagtcctcaagcaagtactttttactatgcaggaaatcactgtttggccttggtttgtggttattcaacacacattccttgtaagtcagattcattctactgacctcaccctccttctcgtggaaagttctatgaatgagacagcaagtctggagactaagtcaggtgcatcacagttagagggtgaaagtctccatctcttccatcgctacaaaacagagggcaacccaagcaaattgtgttcctgaaagctaccaagagaatggaaagatcagcccctagattggtagcacacggtaggtgtccaattaataattttaaaataagcgagtagtggccagacaccatgaaatggaaacggttggcagcctgtgttccgtggtcacttggctattgtagattatttctgcaaagtgagagttgtcttctgctgttcagagagcaaataagaaaacagagggtgagagcccagaacctgtccaggctcagtctccatgatcctgtctgatgcatagactcagcattttgaataggaccgcctggcatgtccagtcttcatggagtgaggagtgtggtcaagctattctgcttagaaggataaggaagcttctaatgagtcctgacttgggcctcccttccgttccaccacccacagattcaggaagcatttactgagtgcagcccacacgcaggagttatggcaatgagcgtgacggacacacatccttctttctgggagcttatgtgctcatggggaggacaatcacacacacacacgtgctgtaatcgtgatgaggcgaattagggagaaatacagggtgacatgaacctggaaaaatgggagcaacttccagctgtgaggggctgggcaggtttaccagtcatctctaaggcgaggcttgggaggggaggcagagggggtgtggtgtggggaagcctttcaccttgggcaaatgtctaaggcagcagctccctcagagcagactcgggaatggcatgcagggctcgattccacgtatggggacgtgggtttactcagttcccgagacgatgcccattctttggttgtcctagtccagaggagatgtctttaccaaactggcacaaggggaccttcgggctggcgggacctgaagtctggctggtttacggaactgaaaatacgacgggtcacaaagggctaaaacctcttggtcatttaccagctgctcctcatagataatggtcctcatctttttacatgtcctggactctctgcccaggtaaagccccgctccaaccactgaccttaccccttagggaggtatcgcttatttccctgcataagctctcatctcctctgctgctgctgctgctgctgctaagtcgcttcagtcgtgtttgactctgtgcgaccccatagatggcagcctacaaggctcccccgtccctgggattctccaagcaagaacactggaatgggttgccattgccttctccgctcatctcctctagatccaaccaaatgcctcatctgcttacatcccattagagtcacctgagacctgggtctgttgctgtcatccccctacgcccagcacatagcacatagaaggtgttcagctaaatgcgttagctgaatgaatggatctgttttcaaaaacacagggacctgtctatgggaacagctgtgcctgaatgcaggcttcattataacatgcatttagcactcacttctgtgcacactacttgcagccatcaaaggggatacatactcttaatttctaacattccacctctctgggacttacatcagtcctccagatgccaccacaaacaaaataaagccgtctcagaaaacaacgccctgacgaccatgctctggatgctgcagaaacgactgtcggtactctctgtcctagcttattaacccttattttacaaacagtgataactgatattcactctctgttgtcctagcctcctgcagaatagaaattgtagaaggaaagcttgggtcgtgggtcaaagagcggaaagaaggaaaagaggaagccagcaaggttagactcttggatgatattgacagacgacaacagattgctaatctaccatcatcgtcactggggcttgagaaagatcttacctggttccaagcagggttagctcagacacagctgctgctgctggggccctcagcacaatactctctcagagacagatgtcttgtacacagttctgcttttctgttctagttcatcctcggtcgttgcctctttggcatgaccattagctgtctgccaccctggcttccttctgtttcctccttctcagccctaacctccgagacaccatggaactgacacattctaattgcatgcaaaacaaaacaaaacaaaactgtataccaactgttaagccacctgatgcaaagaggtggaaaagaccctcatgctggaaaagattgaaggcgggaggagaaggggacgacagaggatgagatggttggatggcatcattgactcagtagacatgagtttgaacaaactctgggagatggtgaaggacaaggaagcctggcatgctgcagtccatggagctgcaaagagtcagacacaactgagcaaccgaacaacaacagcaacaaccatcaagcatttggttctcaatttcttattagctgtaacttggtgatcacacaacccttgaacaacgtaatttcctccaagtataagaagagatgcttaaaactgagaagttttttgcttatgccatttttctttttctggcctctgcctgtggttcagctgccatattttaacttctcctttcccaaaggtcaactccacgctgctgatttgttccttctgaacgtgttcccacttctacccacgatccagagttcaccagtacttccctcaccccctcagccaggctccttccttgggctctgtcctaaggtaacttcattgccgcttcaaagatgccaagtcaccccaacttgcataatttccattttctgcacatagatcatactttttttttgttactaatatttgtcgttgttgttcagttgctcagttgagtccaacactttgccatcccgtggactgcagcatgccagtcttctctggccttcaccatctcctggagcttgctgaagctcacgtccactgagtcagtgatgccatccaaccatctcatcctctgtcatccccttctccttctgccttctatctttcccagcatcaggatcttttctaatgagtcaactctttgcatcaggtggccaaagtattgcagcttcagctttagcttcagcatcaacccttccagtgaatattcaaggttgatttcctttaggattgactggtttgatctccttggagtccaagggactctcaagaatattctgcaacgtcagagttcgaaaaaaattaatattttgctaatattagtaaaaattcatatttttactaatacgtcaggaaatatttagttactttgtatttattgcccagtattctgtaaagcgtagtcagagagatagactggaaaacccaatctttccaactggagtcatctcagcgggtgtgaatacaggaaagcttgagatatgcagtctggagcacctcgccctggctcagagttctgcacctctcacctcagggatgcaagggaacatggtatttctagccacgatgcttttccacagtcttgggggtgctctgcccctttccccatcaagaaaatttagggaattctgctgctgctgctgctgctgctgctaaatcacttcagtcgtgtccgaccctgtgaaaccccatagacagcaacccaccaggctcccccgtccctgggattctccaggcaagaacactggagtgggttgccattgccttctccaatgcatgaaagtgaaaagtgaaagtgaagtcgctcagtcgtgtccgactcctagcgaccccatggactgcagcctaccaagctcctccgtccatgggattttccaggcaagagtactggagtggggtgccattgccttctccaagggaatgatgggataatatcaaagggacaatctttaaaaaaatctttgttttatattggagtatggttgattaacaatgttgtgttagtttcaggtgtacaagtacagaaaagtgattcagttctatgcacacacatatctattctttttaaaattcttttcccatttaggttgttacagagtactgagcagacttccctgtgctatacagtaggtccctgttggttatttatttcagatatagcagtgtgtccatgtctgtctcaaactcgcaatttatccctccaactacccttgtcccacaagttaaccgtaagttctttttccaggtctgtgagactgcttctgttttgtatacaagttccttcgtattatttgttttttgagattcccatatgagtgctatcatatgctattagtctttctctgtctggcttatgtcatttagcatgataattctaggtccgtccatgttgctgcaaatgacatcattccattctttttaacggctgagtaatatttcttcatgtatacatacaacatcttctttattcactcatctgtcgatggccatttagatcacttccacgttttgggtattgtgagcagtacctctatgaacactgcgggtgttgcatgtatcctctcaaaccatgtttttagctggatatatgtccaggagtggggttgctggattatatggtagttctatttttagttttttaaggagcttccactccgtcctccatagtggctgcaccaatttgcattcccatcagcagtgtaggaaggttcaaagggactgctataaatattctgtcctccatttctaagaggagtcatcgttttgaatcaccatatcacaccttacactgagcctcattcatgcagcttagggagctgaggccgagtatgactggccaagatagggctgttttctgagtgcagatcacactttaaagaaagaaattgagttcttgaactgcctttgcttccaaactgctgattacatttagcgggacagcgctgtgctgacagataagccttgaaaaggggtgtttgccgtcacgttcttggttggttgtgctccgtccttactctggagcactatgtgaacacgagtgtctgcaccttcaagctcgaaggctgggattgtcatttctctgactctctgagtctcgatttccttgtgctgaaacacagggatcttaattcccaccacacaagggctgtggtggaaattcaataaaaataattctatgagagcccttagcactgggctggcattaagtggtggcttgataaatattctgctgagcgggaaaagaatggtgtttgcttaggagtccgccacacaatttttcttgataaaagttcacaagtgctctctccccgtgacgtcttgctaaaataagagcaggtggaaactgtctaaagtggaatcacgtacagaaaagatgtgtccattatcattattttatgggctttagttaatcccgtgtgttcctggcttgcattcttttccaggaattgttccgtgggtgaactttgtgagctgggggctgtgataattagaccaaggtcatgcgtctgtcccctgtggcccagttagctcagcttggctccatgtccacacacattgatcttaacccagctggcagacttgcaaatgtgtgatcacatccccaaggacaccgtggggtgggtttctgcgggtctggtgaacaactcctgtctccaggaggagcaaccccccagcagctctccgctatggtgattgtgacctggaggtggcgctgtttctcaaggaaggatggcttgggatgccctcacctcattttccaggcagtatgaaatgatagactgagttactgctaggtaatctggttcaattctttcatttttccaagcaaggaaattgagatccagagatagagaactctttcctgaagccaaaccacagaagcaaggctgaatacaggtctcccagatgatacacttttgtaattttcactaagggtttcctggtccgaatgatattaagcagttaatagtgtttacaacaaaacagaatgaatcattgaatatacctaaactggtgatgtttccaaagagttatatcgtcattgaatttcaaatgcctgttatttctaatcacaggccaggttggatctattttggttttttattatacaaggcatttgtatgtatctgtgtttcaatggatgatttatttttctcttccacacaaatgaaagaaggaaaatgattggtatgggtgaagttgtattctatactgacttgtttgggaaacgtaaacacgatttctgtttaaatgatcacagctgagacgacatgtgggtttttaaaaaggtgctcgtggatagaaggctgataatgaaaatacttcccaggtagccatttttagcccctttcctaattcatggcaagtgaaacacattgggggtggatatagtaggaacatccccgcaggcacgcacagaatcaaaattcagtcttttagaaggtttcctctgtggaaatcacctgtttttttttttttttaagtaagcttttgcttactttccagggagactgagagctgatgggagtgagagaggcaagtcctcctctctcatgagggccttgttacgtgtgctcagtgtggttctccaggcgttcggaattcaaggcagggcctgtgcctctgctcttggcaccaggtaaaacttctcttgagatgctgatggaatagaagacattatcccagggtgtgcgtgggatgatctgggacattgggattcacatatatacactattgatacaatgtataaaatagatgaccagtgagagcctgctttatagatcagagaactctactcagtgctctgtggtgacctaaacatgaaggaaatccaaaaaaagaggggatatatgtaaacatatagctgattcactttgctgtatagtaaaaattaagtgttgtaaagcaactaaactccaataaaaattaataaaaaataaatttttaaaaaaccctccccagtgacagtggcatcttttcccccattcaccttggagaggtggcgtttattagttctgtatttgtttttttccttcagaaataagggaatctaacgcaagcaaatgttttcttttataaaattggggtctactgtatgcaggaagattggattcctacttttttgagaaatattctttctcaaggaacttagatgtttttctattgcaggttcctaaaatgtaacagaattgcagaatcttccggtacctccagccacatgcccttaaatgacacccttttttatatcagcagcacctggaagccggtgaggaaggcagaacctctggcccaccttggacccagggaaacagtgtctgacatgtcgggttccccaggtaagctgttgctgctgctgctaagtcacgtcaggcgtgtccgactctgtgtgaccccatagacggcagcccaccaggctcccccgtccctgggattctccaggcaagaacactggagcaggtaagctgggcccccacaaatgttagaggaaggctggctaggacacacatctatcagggagctgaggtgcctggaaacatttaccttagtttagtctctgttttcatctctcccgttcatgtaattccgtaaatccttagtgaggtctgtgatgcggctgaacagctgagagtaaagatgacatgaccttggcctcatggagctgatcatgggaggtagaaaataaactttacttatatatacggtggctcagttggtaaagaatccacctgcaacgagggagacctaggttcgatccctgggttgaaagattcccctggagaaaggaacggctacccactccagaattctggcctggagagttccgtggacatagagacatgtatggcaatggcaatggcaccccactccagtactcttgcctggaaaatccatggacggaggagcctcataggctatagtccatggggtcgctaagagtcggacacgactgagcgacttcactttcacttttcactttcatgcattcgagaaggcaatggcaacccactccagtgttcttgcctggagaatcccagggacagtggagcctggtgggctgccgcctgtggggtcgcacagagttggacacgactgaagtgacttagtagcagcagcagcatagacatcatattaaaaagcagagacattactttgccaacaaaggtccgtctagtcaaggctatggtttttccagtggttgtgtatggatgtgagagttggactataaagaaagctgagtgcagaagaactgatgcttttgaactgtggtgttggagaagactcttgagagtcccttggatggcaaggagatccaaccagtccatcctaaaggagatcagtcctgggtgttcattggaaggactgatattgaagctgaaactccaatactttggccacttgacgtgaagaactgattcattggaaaagaccctgatgctgggaaagattgaaggcagaaggagagggggacgacagaggatgagatgtttggatggcatcactgatttgatggacatgagtttgagtaagctccaggagttggtgatggacagggaggcctggtgtgctgcagtccatggggtcacaaacagtgggacatgactgagtgactttcactttcactttcatgtcatagaagataagcaatggaagacaataaggcagggtaagaaggtgggagtgtgggaatgaagggtgcagtgacatatgggatggtcagggaagggctgttccaccagccgggcctctgagcagagaggggagggaggtgaaggtgggcacgtgtctgggaggggctgggaaaaccctctgtggccctcttctaaagtcactacgtgggtcactgtgtgggagggttgctagatttagcaaataaaaagacaagatgccctgcatttctgaattgaatttgaggttgaatttcagatctgtaataaatttttggcataatatactaactttttataatatatgtatatataatttaatacatgcattagtacatctttgtcctaagttacagtatatatatgtattttagtacatcccatgccatatttgggaaatattcatactaaaaaaatttcaccatttatctgaaatatattatatataatatttcataatatataatatatatttatttgaaatgtagcatatatgcatcaaattgggctagatgtcctgtattgtatctgtgaacagtggccccagagcaggccatatgcataataaataatacatatttatttgaaatgtaacatatacccatcaaattggactgggtgtcctgtattttagctgtgagcagtgggcccagagcaggccatggctggaggaggtggctttctctgcagaatcactatttcctttctccatcaacccacagcttgcttcgcaggccttggccagtggaacccgggaggcagtggctgttcacgaccttgttgtgttatccccacgggtgatggctggacagggttctcctgaacctgtcttctgcagtcagaaaagaattttctgagctaaattctcctaaaaagtctttcctgtaaaaaaaaaaaaaaagcaaaatacaaaacacccacgtcttagaatacctctagttacacattgcattgtgactgtatcagtcatcacccactggaaaaaaattgccaatcgttcctttgtccatctagtatctgtgggagaatctcctgatttatttgcaggcaaactctatacaacgtgtcatttgccgtctcctgagtgctgttttcaagggggcaagtggcccaggggcccgccccaccacttcccagaacacagggcacaacatccctctacctgtgctcagagtcaagccatgacccttccacgtttttaaagatatttatttatttaattttgattgtgctgggtctttgtttctgtgcgggcttcagtaattgcagcactcaggcttggttgctccacagcatttgagatcttcctagacgagggattgaacccgtatcttctgcattggcaggcggattccttaccactgagccaccagggaaaccccttccacacttttttaatcaaaattaatgtcatttgtttaatcaactgcttatctaacatttgactactgcgtccatggtcaaaaggataaagtgatgctctcttaccctaagggtcattgagaccaggggtccccaacctcctgtagtccctggtggctcagatggtaaagaatctacctgcaatccaggagacccgggttcaatccctgggtcgggaagatcccttggagaaggaaatgacagcccactccagtattcttgcctggagaatcccatggatagaggaacctggcaggctacagtccatggggtctcacagagttggacaccactgagcgactaacactttcactttccccaccctccagcatctaaggctgatgatgtgaggtggaactataatcataataataataatgtcataataataataggactccccttgtggctcagatggtaaagcgtctgtctacaatgcaggagacccaggttccatccctgggtcgggaaggtcctctggagaaggaaatagcaacccactccagtactcttgcctggaaaatcccatggacggaggagcctggaaggctgcagtccatgaggtcgcaaagagtcggacacgactgagcgacttcactttcacttttcactttcatgcattcgagaaggaaatggcaacccactccagtgttcttgcctggagaatcccagggacgggggagcctggtgggctgccgtctatggggtcgcacagagttggacacgactgaagtgacttagcagcagtatagccaattaacaaataatgtgagtttcaggtgaacagctaagggcctcagccatacatatacatgtatccattctctcccaaactttcctcccattcaggttgccacgtaacatcgagcagagttccctctgcgataaagtaggtccttgttggttattcatttttgaatacagcagtgtgcacatgcccatccaaactccccaactatcccttccctccatcctcccactatcctccccagctgcgccacaaccacaagcccacacgacaacaagtgcggcttaagagaggtcacagctggtgttagaaatagaacttcctctctttctcctgactcagggcagtggctggcagcagggactcggtggcctattgtaatgaatttctagattcttctctgtatgtgtcacgggtcctggggtgggcctggagtgagccagacaatgggataactttgatcgaagtattttgtacaagtaatgccagcactgtgaactcagcttgaaagtaattgcaaagacatggattctaaagtacccctggaggtgacaatttcccccatgtaattaggaatatactttatctttgtttcttgtgctctgttttcagtgaacatgagtaggcctatctgaaaagaaattaatttgctgtttatgttagtttgtggctttgttggaggtgcaaacaggcgtagaccccctgtctgctcttgtttggtgtgccagagtatttctgttgggtcaactgatttgcaattctaaaaactagtttcaaaatttgggattgtgaattaaattgatgtgtgtattgcatttgtatttttcacattctacaggcttttctactcatcagttatggacttaaatatgtgaaacttgtactctttgatggaaacttcaggatgaaagtagaatattccataaaaatggaaaacaggaaaactaccaccaaagatcaaacaaaagcaattaaccagccaaccaaaaaagtaaacaagaagaagaaagaacacttacattttaattacccacattttaatttttataactcaggttatatcagcatgaatttgaaaaaaattaacttacaggtgaattttttaaacataatatttaagtaggaagtttgataccagtttggggttttttttttggttgatgaatatagttttcacattaagtagcttagaagagaaactttatataatttgcacactaactgtagaagtcatgctatttgtagcagttatatattttaaaataattctttgcttagtataatatcgatgcatatatattgtggggaattgaggacatagagataagcaaaaagaagacaataataatcacaccagacagggaggaactttgtgaattttagggtacctctttccagttcttttttctacatgtatttttagaaaaaaatggtattgcccacattctttaaaatttcttgtttaatttgtatattacatgaggaaggaaggagactggaatggcaacgaagaaaaatgaaattttgcagtaactccgataataacacacgacacaaagagcttctagacagagaaaaacagagtgcccacgttctctgctgcttttatttatgtcgaagtaacaatccgtggcgccctgaaaatttcaccatcagagttgtttatttgttttgcttggttgaaagtgtacatcttcatgacgtaagaaggaaggatacgtaggattaacttttcatttttagttgtgactcatttcagaaacatttgaaatttccatccttgacatatttgaagcttgcaatccatgtacgtgcaagtctacgtagtcatccttcattacgtggatttaggcaaactaacacatcttcccccctgcttttaacaggaatgtctagcttcaagctgcctgtgctagaggcaggcatagccaaggagaagctgaatggggccagagcagtcagttcaccccaggccagaggccaccgggagaccctgctgcgttgactcattacagcgaaacgtgcagccaaagaaactgaaaaacttcacgtgttggcccaacccctgaaaatggtcggaaaaggagactccaggaaacaaatggacttatgcttcatcatcagaaaggtctgctgtgtttacagacagaagccagcatgaaaacaataggaacaaaaatagctgcgcatgtcagctgggtgtgtcaccatattgtactcaacgtgaggatattaatttcacagtttttgtgggtaagtttaaacataggaacatgtcacaaataagcagcaagctccacgaggctatatcagctgggatttcacagtctgcaatttttaaattcagctgggtccccaagggccaatcaatattggtggcaattattcttagtacacagtccaaatgaaatgggtgtgttttttttcttttttgtcaaggtgggagatggtgatatagcaataagccagtccccttgtggatggcaattgggccgcctagcagctgcagccagtcggctgtgcgtctcttctggccgtttctcgggaatagtccaataatgaccccattattttaacccttcagcgtgagctgtgtttggtagctagcttggaaaaacctggcatgtgtcaaacaaagagagaatgaaaacaaaacaaaacaacaacaacaataacataaaaaccccaaaccaaagcagcagcacctcccaaggcaactgctcggccgcagcactaccttatacacagcttttatttataccctggtttctaagccgcagcctctagagggccagtgcttgggacacagggatgttttcacgaagcagagtcaattttcattctagagcgaaagcagttgaaaacttaaaaaaaaaaaaaattttttttttcctccaaaaggtagatactgaattatgtacatccctagattttattcattgaaaagttagttttttttcttcttcttctttaacttttgttctatttagggggagtttggggaggagtttgggggagtgggggtagagatggtggggaatggggaacagagaatcagaggagaagtgggtctcagaatgacggtccaagttccttttcctggcggggcccaagtctgagttagtcagcgctcactgggagggatttggctggcaagagtcacgaaacccaggtcagagcggggcagaggagcaacaggagaatgcactccttccaacacagtagggtcctgtttgactttcctaatccttggagcaggcttcatttgtcttcagcctcgtctcagattgggccttttcattttgctttttatctaattaatcacttaagatatcagagtactaatgtcattttatattagctgataaaacaaaaccccaaacaaaactctcctctgaccctacctgtgttttcaaactgccatttctcttaaaaaacattacaagaaatgaaacattctggaaaagagccaaagatatgaacagaaaaaggccataataatagcaacccggtggttctttctacaaacccaataatccattagccactttgaaattagggattcttctgatggaatttggttattttcctctctcgatttgaaatagaaactagaacgaaagggaaattttagaggttaaggtcataaaattctttgtgccctctgaaagttccaggtgaaggtagataatcatctattatttggaggggactccaggaaggaggtaaggatgaataaacagaactgggggctattgagtttaaaatagtatttaattttttcttgccaaaaaaaaaaaagtatggaaggggtactcattcacttattccatactgccttttccgtaatcatgattctttccgtttctttgagtgagtggatcaaagtcaacaggaactggtggttagaagtcaatattctaaagttcaaaaatacattctctttcccccttcccccactttgaaaatgttttacaataaagactcccaattgcaatggtgactggtggttaatgtcattagacttctggtttggtttaatgctgctaattagtttctgtccttgactttttccaattaaagcatagaggccttggtgctaaacacctgggcagattacctaattagatgacagaaacatacacagtcattcgtaggtaattgttttaactttcactgcatctgtggtattaaacacactgatggaaagggcacactttttgtaccctactcgtcagaatatcagttcgttggcaaggaagctggtactggtattgccttctaaacagacaatgcagagtccctttgggtgaatatgctcagaagtgacagatttgagttttccccctcagacgtaggagaaaacacacatgcgagtcattcccactctgtccctcacacgttcctttgaggaggcagtttcctccgactggtcaagtagaacttgaaactctctgtgtgggtgaacaaccatactgggcattttggaagtgtgcttttcggttccagtgctgaataatttggggggagcctctttgctctacaggcaggttcggtggctcaggcggtaaagaatctgcctgcaatgtgggagacgtgggtttgatccctgggttaagaagatcccctcgagaaaggaatggcaacccactccagtattctggcctggagaatcccatggacagaggagcctgacgggctacggtccatggggtcgtaagagcctaacacgactgagcaactcacaatttcattgctttaaaggtgggatgtattctgtggtttagaaatcagaactgaaaacccaacttctgctctttttacattcttaaaagtggaaaagactaaaagctactgggatcttttcagccgtggccgtggcgccatggatcgttattctgaacttgcaggcgcacacaggaagggtcgggtccagacagcgcctgcactgggacccagaggacatctctacccttcggagcacacgactggactcttgtgtcagatctccactcactgtggcaactggcctctgtgacctcagcctcacccagcccctgaggaccagcccaaggacgcccctggccatttcctaagccttctctggctttccttcccttgattttgctgttattaattccccttccagtcagacctcctagcacatcttcatcccctgggaccctctgtcccctttgggatccacctcccccaagatgccccttctgcaaagcctttcctagaattctcagttgacgtgatttatttctcttgccctggaaaccctgtagcttgtgtttctctcccatgagcctccctgcattctggattattatttattttttaattgaaggataattgttttacaatactgtgttggtttctgccattcatcaacaggaatcaatcgtaggtatacatgtccttttcctcttagtctccctcccacctcccaccctatcccacccctctaggtagtcatggagcaccagtttgagctccctgagtcatacaacaaattcccactggctctctctttcacatatggtcgtggatatgtttccacgctactctgtccattcatcccaccttcccgtccccgccctgagtccacaagtctgtattctgttttgtcttagtgttatttgaggccctatcttaactatgacattatcagcctcttcaataatttgctcagcaaacgtttaccaagtgcttgacatgcgctaggtgctgaggattcagtgataacagaataaacttctgcctgcattgactttacagtccaaggagggcagagagcaaacaagcaaaggaacaaatgtatatcattaggtcatacagtgataatagccacgaaggaaagagtatcactaaacagagcgatgaaggagataatttacaaaatgatgaccctcagtgagcaagtatggttgtcaactgtatccattagtctgtctaatcctcacaacacaaactacaaactacaactacaaactagataccagacctcagtacgattcctgggttgggaagatccctggagaagggaaaggctacccaatccagtattctggcctgggtcacaaagagtcggacacggctgagagacttcactttttcactagtaatcccattctagagaagagacattgagaccagagcggttaggaaacttggctgaggtcacacagctggtcagtagccacctgctcaccttcccttcttccttgtctggccacaacagtgcctggagcacaccttggagtaaaggccttgatgacctacatgggtcgcgcatctgcggatttcttcctccgacatgacagggtgctgggtcagaagggtggacttcctgcagccccaggaggacacctcaatcaggtgagcccagcagatgcttgtcccaagaatttggcgtggggctgaggcaggccttaggggtggctggatatgaaccgggacatggctgccagaggtggtctttcctgcaggggaagtgtgagaagcaggcacagggcgggaggcacgcccacccccccatctcctcccacagcacctgttctctccaccagccacgcttaccatccaccttgcagtcagacccccactttctggaaatctgtctagtcctgttcgcacagcctagagcttactgttgggagttggtggttgaataaatggatgcatggatgaacaaatgctggggagagaaggcctaactacatcagggaatcatctggagaaggggttaaaatgttagttctccggcctcatactgatttagtcagtcccagggagagcctgagaatctgcttagttacaagccctacagctattctgatacagggagtgtgagaattacagagttcgatcagctacagtctcctgggtctgctaataacgccagctctctgacagcctcacctgtagcacactgactttgtgccaggctcgtgctcagaccctcacacatgtttttcaccctgagggagagttctgcgaggtggtggtcctctggtttgacagtgtcagatcacaggcatattaagtccctggccacggcctccgggtgaggtgcccacaggagcgctctggccctgggctcttttgagcatcctctccttgtttggagatatctccatcccctgagtctgctcctcctccaggaagcacccagacacttgctttcccagcctctcggtgccacctgagacctggccccaccaatcaaacgtcccaacttgaagtttgattcaggaccagccgacaccaagaagtgtgatctgcagggacccttgggggcagccctggcagagtttctagcactgcatgcggtgtccagtgtccccgatatgaactttgggggtctctgcccagcaggagtggcgcaggcctccactgcagcacccctgcaatgcactgtgtgctatgctcctgtctgtggagttcttgttctgggcgtctgttcctgtgtaagctatcactccagaacctagaggctgaaagcaatggcaatatttattttgcatgtcaatctgcaacttgggaaaggctcacaaggacaatcatttctgttccactcagacttgaaggca

(The sequence listing continues in the following parts.)

What is claimed is:

1. A method for identifying a bovine animal having Polled phenotype, as compared to a general population of bovine animals, comprising:
    (a) obtaining a biological sample from said bovine animal;
    (b) subjecting the sample to nucleotide sequence analysis to obtain sufficient nucleotide sequence information to provide the identity of the nucleotides at positions corresponding to the following SEQ ID NO: 43 positions: 1356048, 1872077, 1872200, 2101528, 2214142, 2220054, 2220178, 2225310, 2288436, 2332892, 2333140, 2338338, 2816109, 2816370, 1013610, 1352705, 1352905, 1431709, 1438531, 1731905, 2128551, 2640799, 2648129, 2650867, 2651006, 2657651, 2676311, and 2820224;
    (c) detecting in said animal a haplotype of the alleles present at at least three nucleotides or a genotype of the alleles present at at least five nucleotides, wherein the at least three or at least five nucleotides in the haplotype or the genotype are nucleotides detected at the positions analyzed in part (b), wherein said haplotype or said genotype is sufficient to conclude that the animal will exhibit the Polled phenotype;
    (d) identifying the animal as having the Polled phenotype based on the presence the haplotype comprised of at least three of said positions or the genotype comprised of at least five positions.

2. The method of claim 1 wherein:
    (a) the animal is of the Limousin breed and a three SNP haplotype is detected;
    (b) the animal is of the Hereford breed and a five SNP haplotype is detected;
    (c) the animal is of the Shorthorn breed and an eight SNP haplotype is detected;
    (d) the animal is of the Charolais breed and a six SNP haplotype is detected;
    (e) the animal is of the Jersey breed and a four SNP haplotype is detected; or
    (f) the animal is of the Gelbvieh breed and an eight SNP haplotype is detected.

3. The method of claim 2, wherein the three SNP haplotype consists of alleles present at nucleotide positions 1872077, 2288436, and 2332892.

4. The method of claim 2, wherein the five SNP haplotype consists of alleles present at nucleotide positions 1356048, 2101528, 2214142, 2333140, and 2816109.

5. The method of claim 2, wherein the eight SNP haplotype for the Galbvieh breed consists of alleles present at nucleotide positions 1356048, 2220054, 2288436, 2332892, 2333240, 2816109, 2128551, and 2650867.

6. The method of claim 2, wherein the six SNP haplotype consists of alleles present at nucleotide positions 1872077, 2214142, 2332892, 2816109, 1013610, and 1731905.

7. The method of claim 2, wherein the eight SNP haplotype for the Shorthorn breed consists of alleles present at nucleotide positions 2101528, 2128551, 2214142, 2288436, 2332892, 2333140, 2816109 and 1731905.

8. The method of claim 2, wherein the four SNP haplotype consists of alleles present at nucleotide positions 1256048, 2101528, 2288436, and 233140.

9. A method of sub-grouping bovine animals comprising
    (a) identifying bovine animals having the Polled phenotype using the method set forth in claim 1 or claim 2, and
    (b) sub-grouping the animals according to the haplotype or genotype that was detected.

* * * * *

UNITED STATES PATENT AND TRADEMARK OFFICE
CERTIFICATE OF CORRECTION

PATENT NO. : 8,105,776 B2  
APPLICATION NO. : 12/338835  
DATED : January 31, 2012  
INVENTOR(S) : Clare A. Gill et al.

Page 1 of 1

It is certified that error appears in the above-identified patent and that said Letters Patent is hereby corrected as shown below:

Column 48, line 42, (claim 5), "2333240" should be --2333140--

Column 48, line 52, (claim 8), "1256048" should be --1356048--

Signed and Sealed this
Sixteenth Day of October, 2012

David J. Kappos
*Director of the United States Patent and Trademark Office*